US009157121B2

(12) United States Patent
Wolfgang et al.

(10) Patent No.: US 9,157,121 B2
(45) Date of Patent: Oct. 13, 2015

(54) METHOD OF TREATMENT BASED ON POLYMORPHISMS OF THE KCNQ1 GENE

(71) Applicant: Vanda Pharmaceuticals, Inc., Washington, DC (US)

(72) Inventors: Curt D. Wolfgang, Germantown, MD (US); Mihael H. Polymeropoulos, Potomac, MD (US)

(73) Assignee: Vanda Pharmaceuticals, Inc., Washington, DC (US)

( * ) Notice: Subject to any disclaimer, the term of this patent is extended or adjusted under 35 U.S.C. 154(b) by 0 days.

(21) Appl. No.: 14/632,914

(22) Filed: Feb. 26, 2015

(65) Prior Publication Data

US 2015/0167091 A1 Jun. 18, 2015

Related U.S. Application Data

(62) Division of application No. 13/263,074, filed as application No. PCT/US2010/029921 on Apr. 5, 2010, now Pat. No. 8,999,638.

(60) Provisional application No. 61/167,136, filed on Apr. 6, 2009.

(51) Int. Cl.
*C12Q 1/68* (2006.01)
*C12P 19/34* (2006.01)
*A61K 31/454* (2006.01)

(52) U.S. Cl.
CPC ............ *C12Q 1/6883* (2013.01); *A61K 31/454* (2013.01); *C12Q 2600/106* (2013.01); *C12Q 2600/156* (2013.01)

(58) Field of Classification Search
None
See application file for complete search history.

(56) References Cited

U.S. PATENT DOCUMENTS

| 5,364,866 | A | 11/1994 | Strupczewski et al. |
| 5,658,911 | A | 8/1997 | Strupczewski et al. |
| 6,140,345 | A | 10/2000 | Strupczewski et al. |
| 2006/0073506 | A1 | 4/2006 | Christians et al. |
| 2011/0077539 | A1 | 3/2011 | George et al. |

FOREIGN PATENT DOCUMENTS

| WO | 9309276 A1 | 5/1993 |
| WO | 9511680 A1 | 5/1995 |
| WO | 0124681 A1 | 4/2001 |
| WO | 03016504 A1 | 2/2003 |
| WO | 03020707 A1 | 3/2003 |
| WO | 03062791 A1 | 7/2003 |
| WO | 2004057030 A1 | 7/2004 |
| WO | 2006039663 A2 | 4/2006 |
| WO | 2006039663 A3 | 11/2006 |
| WO | 2006124646 A2 | 11/2006 |
| WO | 2006131528 A2 | 12/2006 |
| WO | 2006131528 A3 | 3/2007 |
| WO | 2006124646 A3 | 8/2007 |

OTHER PUBLICATIONS

Sitton, Office Action Communications for U.S. Appl. No. 13/263,074, dated Oct. 2, 2014, 18 pages.
Sitton, Office Action Communication for U.S. Appl. No. 13/263,075, dated Oct. 3, 2014, 19 pages.
Sitton, Office Action Communication for U.S. Appl. No. 13/263,076, dated Oct. 3, 2014, 19 pages.
Sitton, Office Action Communication for U.S. Appl. No. 13/263,077, dated Oct. 3, 2014, 19 pages.
Sitton, Notice of Allowance and Fee(s) Due for U.S. Appl. No. 13/263,074, dated Feb. 11, 2015, 15 pages.
Sitton, Notice of Allowance and Fee(s) Due for U.S. Appl. No. 13/263,075, dated Mar. 6, 2015, 7 pages.
Sitton, Notice of Allowance and Fee(s) Due for U.S. Appl. No. 13/263,076, dated Mar. 10, 2015, 11 pages.
Sitton, Notice of Allowance and Fee(s) Due for U.S. Appl. No. 13/263,077, dated Mar. 13, 2015, 7 pages.
Cascorbi, "Role of Pharmacogenetics of ATP-Binding Cassette Transporters in the Pharmacokinetis of Drugs," Nov. 2006, pp. 457-473, Pharmacology & Therapeutics, Science Direct, vol. 112, No. 2.
Chiang et al., "The Long QT Syndromes: Genetic Basis and Clinical Implications," Jul. 2000, pp. 1-12, Journal of American College of Cardiology, vol. 36, Nol 1 (XP002590440).
Cohen et al., "Cloning and Characterization of FAM13A1—A Gene Near a Milk Protein QTL on BTA6: Evidence for Population-Wide Linkage Disequilibrium in Israeli Holsteins," Aug. 2004, pp. 374-383, Genomics 84, Academic Press, available online at: www.sciencedirect.com.
Derosse et al., "The Genetics of Symptom-Based Phenotypes: Toward a Molecular Classification of Schizophrenia," Jul. 2008, pp. 1047-1043, Schizophrenia Bulletin, vol. 34, No. 6 (XP007913527).
Donger et al., "KVLQT1 C-Terminal Missense Mutation Causes a Forme Fruste Long-QT Syndrome," Nov. 1997, pp. 2778-2781, American Heart Association, vol. 96, No. 9 (XP002922668).
Fujita et al., "Association of ATP-Binding Cassette, Sub-Family C, No. 2 (ABCC2) Genotype with Pharmacokinetics of Irinotecan in Japanese Patients with Metastatic Colorectal Cancer Treated with Irinotecan Plus Infusional 5-Fluorouracil/Leucovorin (FOLFIRI)," Nov. 2008, pp. 2137-2142, Biological & Pharmaceutical Bulletin, vol. 31, No. 11 (XP007913544).
Hegele, "SNP Judgments and Freedom of Association," 2003, pp. 1058-1061, Arteriosclerosis, Thrombosis, and Vascular Biology, vol. 22.
Juppner, "Functional Properties of the PTH/PTHrP Receptor," 1995, pp. 39S-42S, Bone, vol. 17, No. 2.
Levine et al., "Iloperidone: A novel atypical antipsychotic for the treatment of schizophrenia," 2008, pp. 1-7, Formulary Journal.
Liu et al., "KCNQ1 and KCNH2 Mutations Associated with Long QT Syndrome in a Chinese Population," Nov. 2002, pp. 1-7, Human Mutation, Mutation in Brief, vol. 20, No. 6 (XP002590441).
Lucentini, "Gene Association Studies Typically Wrong," 2004, p. 20, The Scientist, vol. 24.

(Continued)

*Primary Examiner* — Jehanne Sitton
(74) *Attorney, Agent, or Firm* — Hoffman Warnick LLC

(57) ABSTRACT

The invention provides methods for the administration of compounds capable of prolonging a QTc interval and methods for predicting whether an individual is predisposed to such QTc prolongation.

15 Claims, No Drawings

(56) References Cited

OTHER PUBLICATIONS ss66324480, rs3775378, dbSNP Short Genetic Variations, NCBI, NLM, 2006, 5 pages.
ss66391863, rs7067971, dbSNP Short Genetic Variations, NCBI, NLM, 2006, 3 pages.
Volpi et al., "Pharmacogenomic analysis shows differences between markers associated with responses of two atypical antipsychotics, iloperidone and ziprasidone, in the treatment of patients with schizophrenia," 2007, Abstract, 57 Annual Meeting of the American Society of Human Genetics.
Volpi et al., "Whole Genome Association Study Identifies Polymorphisms Associated with QT Prolongation During Iloperidone Treatment of Schizophrenia," Jun. 2008, pp. 1024-1031, Molecular Psychiatry, vol. 14, No. 11 (XP002590482).
Yang et al., "Allelic Variants in Long-QT Disease Genes in Patients With Drug-Associated Torsades de Pointes," Apr. 2002, pp. 1943-1948, Circulation downloaded from: circ.ahajournals.org at the European Patent Office.
Patent Cooperation Treaty, PCT Notification of Transmittal of the International Search Report and the Written Opinion of the International Searching Authority, or the Declaration for PCT/US2010/029921 dated Aug. 19, 2010, 15 pages.
Patent Cooperation Treaty, PCT Notification of Transmittal of the International Search Report and the Written Opinion of the International Searching Authority, or the Declaration for PCT/US2010/029931 dated May 27, 2010, 13 pages.
Patent Cooporation Treaty, PCT Notification of Transmittal of The International Search Report and The Written Opinion of the International Searching Authority, or the Declaration for PCT/US2010/029943 dated Jul. 5, 2010, 14 pages.
Patent Cooperation Treaty, PCT Notification of Transmittal of The International Search Report and The Written Opinion of the International Searching Authority, or the Declaration for PCT/US2010/029945 dated Jul. 7, 2010, 13 pages.
Sitton, Office Action Communication for U.S. Appl. No. 13/263,075 dated Oct. 8, 2013, 23 pages.
Sitton, Office Action Communication for U.S. Appl. No. 13/263,076 dated Nov. 29, 2013, 24 pages.
Sitton, Office Action Communication for U.S. Appl. No. 13/263,077 dated Nov. 7, 2013, 25 pages.
ss66046634, rs1083338, dbSNP Short Genetic Variations, NCBI, NLM, 2007, 5 pages.
Cussac, International Application No. PCT/US2010/029931, PCT International Preliminary Report on Patentability, dated Apr. 6, 2009, 7 pages.
Nickitas-Etienne, International Application No. PCT/US2010/029945, PCT International Preliminary Report on Patentability, dated Apr. 6, 2009, 7 pages.
Nickitas-Etienne, International Application No. PCT/US2010/029943, PCT International Preliminary Report on Patentability, dated Apr. 6, 2009, 7 pages.
Lindner, International Application No. PCT/US2010/029921, PCT International Preliminary Report on Patentability, dated Apr. 6, 2009, 7 pages.
Mueller, Frank, Patent Application No. 10713287.0 Office Action dated Jun. 11, 2014, 4 pages.
Sitton, Office Action Communication for U.S. Appl. No. 13/263,075 dated Mar. 20, 2014, 11 pages.
Sitton, Office Action Communication for U.S. Appl. No. 13/263,076 dated Mar. 27, 2014, 11 pages.
Sitton, Office Action Communication for U.S. Appl. No. 13/263,077 dated Mar. 27, 2014, 11 pages.
Genbank Accession No. AJ006345.1, NCBI, NLM; 2006.
Albers et al., "Iloperidone: a new benzisoxazole atypical antipsychotic drug. Is it novel enough to impact the crowded atypical antipsychotic market?" Expert Opin Investig Drugs. 17(1):61-75 (2008).
Office Action for U.S. Appl. No. 14/694,135, dated Jun. 9, 2015, 28 pages.
Office Action for U.S. Appl. No. 14/694,141, dated Jun. 9, 2015, 27 pages.
Office Action for U.S. Appl. No. 14/694,142, dated Jun. 18, 2015, 28 pages.

METHOD OF TREATMENT BASED ON POLYMORPHISMS OF THE KCNQ1 GENE

CROSS-REFERENCE TO RELATED APPLICATIONS

This application is a divisional of co-pending U.S. patent application Ser. No. 13/263,074, filed 5 Oct. 2011, which is a US national stage entry under 35 USC 371 of International Patent Application No. PCT/2010/029921, filed 5 Apr. 2010, which claims the benefit of U.S. Provisional Patent Application No. 61/167,136, filed 6 Apr. 2009. Each of the foregoing is hereby incorporated herein as though set forth in their entirety.

SEQUENCE LISTING

The sequence listing contained in the electronic file titled "VAND-0039-US-DIV_SequenceListing_3-2-2015", created Mar. 2, 2015 and comprising 2.1 MB, is hereby incorporated by reference herein.

BACKGROUND OF THE INVENTION

1. Technical Field

The invention relates generally to the administration of antipsychotics, and more particularly, to the administration of antipsychotics based on an individual's KCNQ1 genotype.

2. Background

Prolongation of the electrocardiographic QT interval (the time between the start of the Q wave and the end of the T wave) is referred to as long QT syndrome (LQTS). LQTS may comprise a genetic component. In some patients with LQTS, QT prolongation can be a chronic condition. In some persons, LQTS may be induced by the administration of an active pharmaceutical ingredient that prolongs the QT interval.

An area of focus in the evaluation of drug safety is the effect of non-cardiac medications on the QT interval. It is thought that the primary mechanism of action by which non-cardiac medications prolong the duration of the QT interval is through inhibition of the Human Ether-a-go-go related Gene (HERG) channel, a potassium channel directly involved in ventricular repolarization. QT prolongation and its relationship to torsades de pointes arrhythmia has received increased attention from regulatory authorities, resulting in warnings on the labels of some antipsychotics.

Since the QT interval changes with changes in heart rate, the QT interval is often measured as a corrected QT (QTc) interval. Any number of formulas may be employed to calculate the QTc, including, for example, the Fridericia formula (QTcF), the Bazett formula (QTcB), and the Rautaharju formula (QTp), among others.

DNA variants in potassium voltage-gated channels, such as KCNQ1, have been identified to predispose patients to drug-associated "acquired" LQTS and are considered congenital LQTS genes.

The KCNQ1 gene encodes a protein for a voltage-gated potassium channel required for the repolarization phase of the cardiac action potential. The gene product can form heteromultimers with two other potassium channel proteins, KCNE1 and KCNE3. Mutations in the KCNQ1 gene are associated with hereditary LQTS, Romano-Ward syndrome, Jervell and Lange-Nielsen syndrome, and familial atrial fibrillation. The gene is located in a region of chromosome 11 that contains a large number of contiguous genes that are abnormally imprinted in cancer and the Beckwith-Wiedemann syndrome.

KCNQ1 alpha-subunits coassemble with KCNE1 beta-subunits to form channels that conduct the slow delayed rectifier K+ current (IKs) important for repolarization of the cardiac action potential. Mutations in KCNQ1 reduce IKs and cause LQTS.

Antipsychotics, both typical and atypical, have been associated with an increase in the duration of the QTc interval. A study comparing the effect of several antipsychotics on the QTc duration showed thioridazine to be associated with the highest degree of QTc prolongation, followed by ziprasidone. Quetiapine, risperidone, olanzapine, and haloperidol were also associated with a prolongation of the QTc interval. In this study, minimum increase in QTc was observed when metabolic inhibitors of the CYP450 isoenzyme responsible for the metabolism of each respective drug, except for haloperidol, which resulted in a doubling of QTc with metabolic inhibition.

As has been seen with other antipsychotics, iloperidone has been observed to have some effects on QTc duration. Iloperidone is metabolized by CYP2D6. Metabolic inhibition by adding an inhibitor of CYP2D6 increases the effect of iloperidone on the QTcF duration. Methods for the administration of iloperidone based on an individual's CYP2D6 genotype are described in International Patent Application Publication No. WO2006039663, which is incorporated herein.

In addition to iloperidone, a number of other compounds are believed to be capable of causing QT prolongation. These include amiodarone, arsenic trioxide, bepridil, chloroquine, chlorpromazine, cisapride, clarithromycin, disopyramide, dofetilide, domperidone, droperidol, erythromycin, halofantrine, haloperidol, ibutilide, levomethadyl, mesoridazine, methadone, pentamidine, pimozide, procainamide, quinidine, sotalol, sparfloxacin, and thioridazine.

Other compounds, in addition to ziprasidone, are suspected of being capable of prolonging the QT interval, although such prolongation has not been definitively established. These include alfuzosin, amantadine, azithromycin, chloral hydrate, clozapine, dolasetron, felbamate, flecainide, foscarnet, fosphenytoin, gatifloxacin, gemifloxacin, granisetron, indapamide, isradipine, levofloxacin, lithium, moexipril, moxifloxacin, nicardipine, octreotide, ofloxacin, ondansetron, quetiapine, ranolazine, risperidone, roxithromycin, tacrolimus, tamoxifen, telithromycin, tizanidine, vardenafil, venlafaxine, and voriconazole.

Individuals at risk of suffering LQTS are advised not to use still other compounds, due to the possibility that they may prolong the QT interval. These include albuterol, amitriptyline, amoxapine, amphetamine, dextroamphetamine, atomoxetine, chloroquine, ciprofloxacin, citalopram, clomipramine, cocaine, desipramine, dexmethylphenidate, dobutamine, dopamine, doxepin, ephedrine, epinephrine, fenfluramine, fluconazole, fluoxetine, galantamine, imipramine, isoproterenol, itraconazole, ketoconazole, levalbuterol, metaproterenol, methylphenidate, mexiletine, midodrine, norepinephrine, nortriptyline, paroxetine, phentermine, phenylephrine, phenylpropanolamine, protriptyline, pseudoephedrine, ritodrine, salmeterol, sertraline, sibutramine, solifenacin, terbutaline, tolterodine, trimethoprim-sulfa, and trimipramine.

SUMMARY OF THE INVENTION

The invention provides methods for the administration of compounds capable of prolonging a QTc interval and methods for predicting whether an individual is predisposed to such QTc prolongation.

A first aspect of the invention provides a method of treating a patient with a compound capable of prolonging the QT interval, the method comprising: determining at least a portion of the patient's KCNQ1 gene sequence; and administering to the patient a quantity of the compound based on the patient's KCNQ1 gene sequence. In some embodiments, the method further includes determining at least a portion of the patient's CYP2D6 gene sequence.

A second aspect of the invention provides a method of determining whether an individual is predisposed to prolongation of the QTc interval, the method comprising: determining at least a portion of an individual's KCNQ1 gene sequence.

A third aspect of the invention provides a method of treating a patient with a compound capable of prolonging the QT interval, the method comprising: characterizing an expression product of the patient's KCNQ1 gene; and administering to the patient a quantity of the compound based on the characterized expression product.

A fourth aspect of the invention provides a method of determining whether an individual is predisposed to prolongation of the QTc interval, the method comprising: characterizing an expression product of an individual's KCNQ1 gene.

The illustrative aspects of the present invention are designed to solve the problems herein described and other problems not discussed, which are discoverable by a skilled artisan.

DETAILED DESCRIPTION

As indicated above, the invention provides methods for the administration of antipsychotics based on an individual's KCNQ1 genotype. The sequence of wild type KCNQ1 (GenBank Accession No. AJ006345.1) is provided herein as SEQ. ID. 1.

As noted above, a large number of compounds are known or suspected to be capable of inducing QT prolongation in some individuals, including individuals not suffering from LQTS. Such compounds may include compounds of Formula (1):

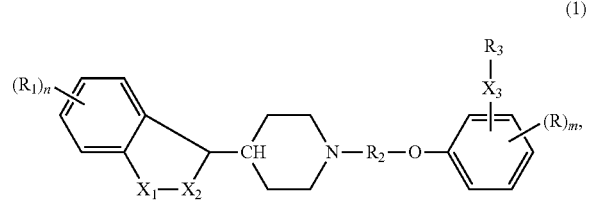

wherein:

R is, independently, hydrogen, lower alkyl, lower alkoxy, hydroxyl, carboxyl, lower hydroxyketone, lower alkanol, hydroxyl acetic acid, pyruvic acid, ethanediol, chlorine, fluorine, bromine, iodine, amino, lower mono or dialkylamino, nitro, lower alkyl thio, trifluoromethoxy, cyano, acylamino, trifluoromethyl, trifluoroacetyl, aminocarbonyl, monoaklylaminocarbonyl, dialkylaminocarbonyl, formyl,

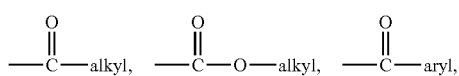

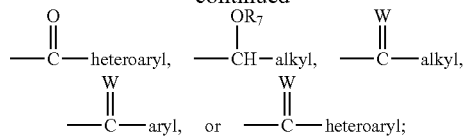

alkyl is lower alkyl, branched or straight and saturated or unsaturated;

acyl is lower alkyl or lower alkyloxy bonded through a carbonyl;

aryl is phenyl or phenyl substituted with at least one group, $R_5$, wherein each $R_5$ is, independently, hydrogen, lower alkyl, lower alkoxy, hydroxy, chlorine, fluorine, bromine, iodine, lower monoalkylamino, lower dialkylamino, nitro, cyano, trifluoromethyl, or trifluoromethoxy;

heteroaryl is is a five- or six-membered aryl ring having at least one heteroatom, $Q_3$, wherein each $Q_3$ is, independently, -O-, -S-, —N(H)-, or —C(H)=N-

W is $CH_2$ or $CHR_8$ or N—$R_9$;

$R_1$ is —H, lower alkyl, -OH, halo, lower alkoxy, trifluormethyl, nitro, or amino;

$R_2$ is $C_2$-$C_5$ alkylene, alkenylene (cis or trans), or alkynylene, optionally substituted by at least one $C_1$-$C_6$ linear alkyl group, phenyl group or lower akylenyl

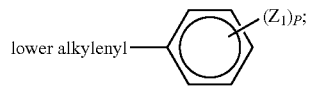

where $Z_1$ is lower alkyl, -OH, lower alkoxy, -$CF_3$, -$NO_2$, -$NH_2$, or halogen;

$R_3$ is lower alkyl or hydrogen;

$R_7$ is hydrogen, lower alkyl, or acyl;

$R_8$ is lower alkyl;

$R_9$ is hydroxy, lower alkoxy, or —$NHR_{10}$;

$R_{10}$ is hydrogen, lower alkyl, $C_1$-$C_3$ acyl, aryl,

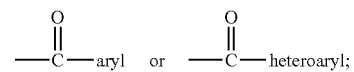

heteroaryl;

$X_1$, $X_2$, and $X_3$ are, independently, -O-, -S-, =N-, or —N($R_3$)-, or $X_1$ and $X_2$ are not covalently bound to each other and are, independently, -OH, =O, -$R_3$, or =$NR_3$; lower is 1-4 carbon atoms;

m is 1, 2, or 3; and n is 1 or 2.

The compound may further include a compound of Formula (1) wherein:

R is —C(O)$CH_2$OH, -CH(OH)C(O)$CH_2$OH, -C(O)OH, CH(OH)$CH_3$, or C(O)$CH_3$;

$R_1$ is halo;

$X_1$ and $X_2$ are different and are =O, -OH, =N-, or —O-;

$R_2$ is $C_2$-$C_4$ alkylene or alkenylene;

$R_3$ is hydrogen, methyl, or ethyl;

$X_3$ is —O-; and

R is substituted as shown in Formula 1A

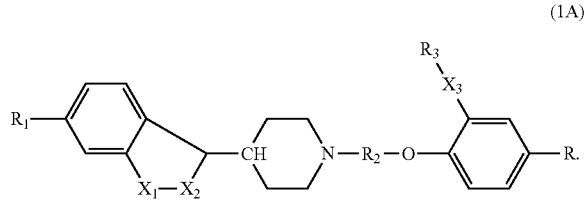

In a further embodiment, the compound may be iloperidone, which is also referred to as 1-[4-3-[4-(6-fluoro-1,2-benzisoxazol-3-yl)-1-piperidinyl]propoxy]-3-methoxyphenyl]ethanone, as shown in Formula 1B:

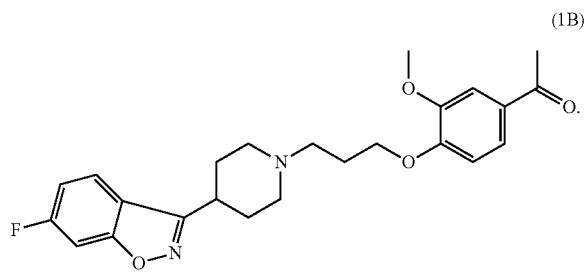 [SMILES: COc1cc(C(C)=O)ccc1OCCCN1CCC(c2noc3cc(F)ccc23)CC1]

Iloperidone is disclosed in U.S. Pat. Nos. 5,364,866, 5,658,911, and 6,140,345, each of which is incorporated herein by reference. Metabolites of iloperidone may also be capable of prolonging a QT interval. Metabolites of Iloperidone, e.g., 1-[4-[3-[4-(6-Fluoro-1,2-benzisoxazol-3-yl)-1-piperidinyl]propoxy]-3-methoxyphenyl]ethanol, as shown in Formula 1C:

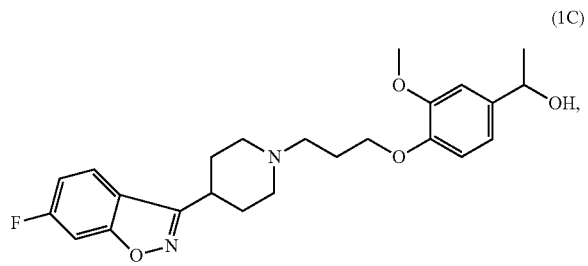 [SMILES: COc1cc(C(C)O)ccc1OCCCN1CCC(c2noc3cc(F)ccc23)CC1]

are described in International Patent Application Publication No. W003020707, which is also incorporated herein by reference. Other iloperidone metabolites include: 1-[4-[3-[4-(6-Fluoro-1,2-benzisoxazol-3-yl)-1-piperidinyl]propoxy]-3-hydroxyphenyl]ethanone; 1-[4-[3-[4-(6-Fluoro-1,2-benzisoxazol-3-yl)-1-piperidinyl]propoxy]-3-methoxyphenyl]-2-hydroxyethanone; 4-[3-[4-(6-Fluoro-1,2-benzisoxazol-3-yl)-1-piperidinyl]propoxy]-3-hydroxy-α-methylbenzene methanol; 4-[3-[4-(6-Fluoro-1,2-benzisoxazol-3-yl)-1-piperidinyl]propoxyl-2-hydroxy-5-methoxy-α-methylbenzenemethanol; 1-[4-[3-[4-(6-Fluoro-1,2-benzisoxazol-3-yl)-1-piperidinyl]propoxy]-2-hydroxy-5-methoxyphenyl]ethanone; and 1-[4-[3-[4-(6-Fluoro-1,2-benzisoxazol-3-yl)-1-piperidinyl]propoxy]-2,5-dihydroxyphenyl]ethanone. See U.S. Pat. No. 5,364,866 and International Patent Application Publication Nos. W09309276 and W09511680, which are incorporated herein by reference.

The DNA variants in KCNQ1 noted above were examined for correlation with iloperidone-induced QT prolongation. These single nucleotide polymorphisms (SNPs) are shown in Table 1, below.

TABLE 1

| KCNQ1 SNPs Linked to Acquired LQTS | | |
|---|---|---|
| Genbank Accession No. | Position | Mutation |
| AJ006345.1 | 79764 | C to G |
| AJ006345.1 | 286414 | G to A |
| AJ006345.1 | 78927 | A to C |

The sequence of KCNQ1 (GenBank Accession No. AJ006345.1) including the polymorphism at position 79764 is provided herein as SEQ. ID. 2; the sequence of KCNQ1 (GenBank Accession No. AJ006345.1) including the polymorphism at position 286414 is provided herein as SEQ. ID. 3; and the sequence of KCNQ1 (GenBank Accession No. AJ006345.1) including the polymorphism at position 78927 is provided herein as SEQ. ID. 4.

Individuals from an earlier study of CYP2D6 genotypes and a predisposition to QT prolongation were genotyped at each of the KCNQ1 SNPs above. 22 individuals had been given a dose of 8 mg of iloperidone b.i.d., 30 had been given 12 mg b.i.d., and 22 had been given 24 mg q.d.

Results for the position 79764 SNP are shown below in Tables 2 and 3. As can be seen, individuals homozygous for the C>G polymorphism showed a significantly greater increase in QTc interval following the administration of iloperidone. In fact, the average QTc change in individuals with the GG genotype was more than twice the change in individuals with a non-GG genotype.

TABLE 2

79764 SNP Genotype and QTcF Change Following Iloperidone Administration

| Genotype | n | QTcF change (msec) |
|---|---|---|
| CC | 13 | 10.38 |
| CG | 32 | 6.80 |
| GG | 26 | 17.58 |

TABLE 3

79764 SNP Genotype and QTcF Change Following Iloperidone Administration

| Genotype | n | QTcF change (msec) | P value |
|---|---|---|---|
| Non-GG | 45 | 7.83 | 0.0008 |
| GG | 26 | 17.58 | |

The results were similar when ziprasidone was administered at a dosage of 80 mg b.i.d. The QTc changes for each genotype are shown below in Tables 4 and 5.

TABLE 4

79764 SNP Genotype and QTcF Change Following Ziprasidone Administration

| Genotype | n | QTcF change (msec) |
|---|---|---|
| CC | 5 | 8.30 |
| CG | 14 | 6.19 |
| GG | 6 | 15.32 |

TABLE 5

79764 SNP Genotype and QTcF Change Following Ziprasidone Administration

| Genotype | n | QTcF change (msec) | P value |
|---|---|---|---|
| Non-GG | 19 | 6.75 | 0.084 |
| GG | 6 | 15.32 | |

Similar results were observed for the 286414 position SNP, the results of which are shown below in Tables 6 and 7. Individuals homozygous for the G>A polymorphism experienced average QTc increases more than double those experienced by individuals with a non-AA genotype.

TABLE 6

286414 position SNP Genotype and QTcF Change Following Iloperidone Administration

| Genotype | n | QTcF change (msec) |
|---|---|---|
| AA | 32 | 12.50 |
| AG | 18 | 3.15 |
| GG | 7 | 10.34 |

TABLE 7

286414 position SNP Genotype and QTcF Change Following Iloperidone Administration

| Genotype | n | QTcF change (msec) | P value |
|---|---|---|---|
| AA | 32 | 12.51 | 0.0268 |
| Non-AA | 25 | 5.16 | |

The 78927 position SNP also yielded similar results, shown below in Tables 8 and 9. Again, individuals homozygous for the A>C polymorphism experienced average QTc increases more than double those experienced by individuals with a non-CC genotype.

TABLE 8

78927 position SNP Genotype and QTcF Change Following Iloperidone Administration

| Genotype | n | QTcF change (msec) |
|---|---|---|
| AA | 10 | 7.21 |
| AC | 31 | 9.19 |
| CC | 33 | 14.08 |

TABLE 9

78927 position SNP Genotype and QTcF Change Following Iloperidone Administration

| Genotype | n | QTcF change (msec) | P value |
|---|---|---|---|
| Non-CC | 41 | 6.46 | 0.057 |
| CC | 33 | 14.08 | |

As noted above, and as described in International Patent Application Publication No. WO2006/039663, an individual's ability to metabolize iloperidone may be predicted based on his/her CYP2D6 genotype. The CYP2D6 gene is highly polymorphic, with more than 70 allelic variants described so far (see http://www.cypalleles.ki.se/).

The two most common polymorphisms within the CYP2D6 gene in Caucasian populations, CYP2D6G1846A and CYP2D6C100T, result in a "poor metabolizer" phenotype and thus higher circulating drug levels in the blood. The CYP2D6G1846A polymorphism represents a G to A transition at the junction between intron 3 and exon 4, shifting the splice junction by one base pair, resulting in frameshift and premature termination of the protein. The CYP2D6C100T polymorphism, also known as CYP2D6P34S, represents a C to T change that results in the substitution of a proline at position 34 by serine. Both of these polymorphisms have been associated with reduced enzymatic activity for different substrates.

Interestingly, a relationship was found between the KCNQ1 polymorphisms above and an individual's metabolizer status (i.e., "extensive," "intermediate," or "poor"), as predicted by whether the individual has one or both of the CYP2D6G1846A and CYP2D6C100T polymorphisms.

Tables 10 and 11 below show CYP2D6 metabolizer status against QTcFmax change from baseline for individuals having GG and non-GG genotypes, respectively, at the KCNQ1 79764 position SNP.

TABLE 10

QTcF Change in Individuals Having KCNQ1 79764 Position SNP Genotype GG and Varying CYP2D6 Metabolizer Status

| CYP2D6 Metabolizer Status | n (%) | QTcFmax Change (msec) |
|---|---|---|
| Extensive | 17 (65%) | 16.4 |
| Intermediate | 8 (31%) | 18.1 |
| Poor | 1 (4%) | 33.6 |

TABLE 11

QTcF Change in Individuals Having KCNQ1 79764 Position SNP Genotype Non-GG and Varying CYP2D6 Metabolizer Status

| CYP2D6 Metabolizer Status | n (%) | QTcFmax Change (msec) |
|---|---|---|
| Extensive | 37 (82%) | 8.3 |
| Intermediate | 7 (16%) | 3.1 |
| Poor | 1 (2%) | 24.6 |

As can be seen, individuals who are GG at the 79764 SNP experience greater QTc prolongation than do individuals who are non-GG. In addition, within each group, and particularly among GG individuals, CYP2D6 metabolizer status is highly predictive of the relative degree of QTc prolongation an individual will experience. Thus, an individual who is GG at the KCNQ1 79764 SNP and a CYP2D6 poor metabolizer may be administered a lower dose of iloperidone or other QT-prolonging compound, due to the individual's greater likelihood of experiencing more severe QT prolongation. Alternatively, the individual may instead be administered a compound not known or suspected of causing QT prolongation.

In order to assess the CYP2D6 component to such prolongation, QTc change was separately compared to the CYP2D6G1846A and CYP2D6C100T polymorphisms. These results are shown below in Tables 12 and 13. As can be seen, individuals homozygous for the wild-type allele (G for CYP2D6G1846A and C for CYP2D6C100T) experienced less QT prolongation than did individuals having one or two mutant alleles (A for CYP2D6G1846A and T for CYP2D6C100T).

TABLE 12

CYP2D6G1846A Polymorphism Compared to QTc
Change Following Iloperidone Administration

| Genotype | n | QTcF change (msec) | P value |
|---|---|---|---|
| GG | 52 | 11.1 | |
| AG | 14 | 15.9 | |
| AA | 2 | 41.6 | |
| GG | 52 | 11.1 | 0.0594 |
| Non-GG | 16 | 18.5 | |

TABLE 13

CYP2D6C100T Polymorphism Compared to QTc Change
Following Iloperidone Administration

| Genotype | n | QTcF change (msec) | P value |
|---|---|---|---|
| CC | 54 | 10.8 | |
| CT | 14 | 16.9 | |
| TT | 3 | 31.3 | |
| CC | 54 | 10.8 | 0.0281 |
| Non-CC | 17 | 19.2 | |

Tables 14 and 15 below show QTc changes in individuals grouped according to their KCNQ1 79764, CYP2D6G1846A, and CYP2D6C100T genotypes. This shows that individuals who were non-GG at KCNQ1 79764 and were homozygous for the wild-type allele at the CYP2D6 loci (i.e., GG for CYP2D6G1846A and CC for CYP2D6C100T) experienced the least QT prolongation. Similarly, individuals who were GG at KCNQ1 79764 and had one or two mutant alleles at the CYP2D6 loci (i.e., AG or AA at CYP2D6G1846A and CT or TT at CYP2D6C100T) experienced the greatest QT prolongation.

This may make it possible, for example, to manage the risk associated with the administration of compounds capable of prolonging the QTc interval. Individuals possessing only the wild-type alleles at the KCNQ1 and CYP2D6 loci may reasonably be expected to experience relatively little QTc prolongation while individuals possessing one or more mutant alleles may be expected to experience greater QTc prolongation, with the extent of prolongation increasing with an increasing number of mutant alleles. Individuals would then be administered a dosage of the compound based on his/her KCNQ1 and/or CYP2D6 genotypes or may be administered another compound instead that is not known or suspected of prolonging the QTc interval.

The data in Tables 14 and 15 also suggest that KCNQ1 polymorphisms have a greater impact on QTc prolongation than do the CYP2D6 polymorphisms. This may provide greater detail in the risk management, testing, and treatment methods above.

TABLE 14

QTcF Change Compared to KCNQ1 79764 and CYP2D6G1846A
Genotypes Following Iloperidone Administration

| | QTcF change (msec) | |
|---|---|---|
| KCNQ1 79764 non-GG | 7.6 (n = 34) | 9.6 (n = 6) |
| KCNQ1 79764 GG | 19.5 (n = 15) | 25.5 (n = 10) |
| | CYP2D6G1846A GG | CYP2D6G1846A non-GG |

TABLE 15

QTcF Change Compared to KCNQ1 79764 and CYP2D6C100T
Genotypes Following Iloperidone Administration

| | QTcF change (msec) | |
|---|---|---|
| KCNQ1 79764 non-GG | 7.4 (n = 35) | 12.6 (n = 7) |
| KCNQ1 79764 GG | 19.2 (n = 15) | 23.5 (n = 10) |
| | CYP2D6C100T CC | CYP2D6C100T non-CC |

Additional KCNQ1 SNPs were examined for any correlation to a predisposition to QTc prolongation. Those SNPs are shown below in Table 16. SNPs useful in the practice of the invention include those listed above and in Table 16 below, and can be used singly or in any combination of two or more.

TABLE 16

KCNQ1 SNP Genotypes and QT Prolongation Following Administration of Iloperidone

| Affymetrix SNP No. | rs_number[1] | Position[2] | Lowest QTc change | P value[3] | Allele A | Allele B |
|---|---|---|---|---|---|---|
| SNP_A-1861793 | rs234873 | 2764098 | nonAA | 0.110421 | C | T |
| SNP_A-1905847 | rs233446 | 2794201 | nonAA | 0.12044 | A | C |
| SNP_A-1905948 | rs179428 | 2507085 | nonAA | 0.548076 | A | G |
| SNP_A-2063010 | rs10832134 | 2459062 | AA | 0.613499 | C | T |
| SNP_A-2070173 | rs10832405 | 2605095 | nonAA | 0.421724 | G | T |
| SNP_A-2128672 | rs10798 | 2826741 | nonAA | 0.149325 | C | T |
| SNP_A-2138827 | rs548566 | 2739224 | AA | 0.533236 | A | G |
| SNP_A-2155585 | rs231915 | 2705591 | nonAB | 0.811901 | A | G |
| SNP_A-2170993 | rs170786 | 2707279 | BB | 0.609952 | C | T |
| SNP_A-2176134 | rs10766379 | 2782775 | BB | 0.149903 | A | G |
| SNP_A-2203798 | rs8181588 | 2788117 | nonBB | 0.486341 | A | G |
| SNP_A-2217853 | rs179429 | 2507306 | BB | 0.323283 | C | T |
| SNP_A-2244304 | rs7128926 | 2653320 | AB | 0.074244 | C | T |
| SNP_A-2264175 | rs6578283 | 2630151 | BB | 0.385571 | A | G |
| SNP_A-2299737 | rs163177 | 2794989 | AA | 0.03059 | A | G |
| SNP_A-2301145 | rs163166 | 2781804 | BB | 0.147875 | G | T |
| SNP_A-2305877 | rs231916 | 2704944 | nonAB | 0.033582 | A | G |
| SNP_A-4241656 | rs231907 | 2708706 | nonBB | 0.802946 | A | T |
| SNP_A-4242308 | rs2283208 | 2700435 | AA | 0.019908 | A | G |
| SNP_A-4248246 | — | 2667398 | nonAA | 0.381774 | C | T |
| SNP_A-4254887 | rs231348 | 2630257 | nonBB | 0.626472 | A | G |
| SNP_A-4257005 | rs16928297 | 2442696 | AA | 0.483607 | G | T |
| SNP_A-4281714 | rs3852527 | 2783179 | nonAA | 0.197306 | A | G |
| SNP_A-4288131 | rs231890 | 2732635 | nonAB | 0.573 | C | T |

TABLE 16-continued

KCNQ1 SNP Genotypes and QT Prolongation Following Administration of Iloperidone

| Affymetrix SNP No. | rs_number[1] | Position[2] | Lowest QTc change | P value[3] | Allele A | Allele B |
|---|---|---|---|---|---|---|
| SNP_A-4288827 | rs10766218 | 2594657 | AA | 0.357049 | A | G |
| SNP_A-4301076 | rs163171 | 2777641 | nonAB | 0.259187 | C | T |
| SNP_A-4301585 | rs9666537 | 2642440 | nonBB | 0.262343 | C | T |
| SNP_A-4302062 | rs1971929 | 2729947 | AA | 0.611517 | C | G |
| SNP_A-4302119 | rs3852528 | 2783193 | nonBB | 0.041388 | A | G |
| SNP_A-1819033 | rs151291 | 2731415 | nonAA | 0.260891 | C | T |
| SNP_A-1824380 | rs179409 | 2483882 | AA | 0.310425 | C | G |
| SNP_A-1829337 | rs231873 | 2742118 | nonAB | 0.422393 | C | G |
| SNP_A-1845199 | rs2412058 | 2597705 | AA | 0.29063 | C | T |
| SNP_A-1866128 | rs12804445 | 2834275 | BB | 0.431295 | A | C |
| SNP_A-2045452 | rs7942590 | 2590291 | AA | 0.7495 | C | G |
| SNP_A-2078818 | rs4430486 | 2741967 | BB | 0.177528 | C | G |
| SNP_A-2089816 | rs10741669 | 2600056 | nonAB | 0.154721 | C | T |
| SNP_A-2108877 | rs10766212 | 2589728 | AA | 0.181241 | A | G |
| SNP_A-2111327 | rs11517737 | 2481124 | nonAB | 0.612965 | A | G |
| SNP_A-2115624 | rs4930013 | 2818735 | AB | 0.762452 | G | T |
| SNP_A-2139714 | rs4930149 | 2692602 | AA | 0.42212 | A | C |
| SNP_A-2147212 | rs11023096 | 2484579 | BB | 0.011594 | A | G |
| SNP_A-2167641 | rs7927129 | 2672108 | nonAA | 0.905521 | A | C |
| SNP_A-2185200 | rs231901 | 2687761 | AA | 0.399107 | C | T |
| SNP_A-2188014 | rs2237866 | 2486738 | AA | 0.016676 | C | T |
| SNP_A-2199433 | rs12576156 | 2455394 | nonAA | 0.055461 | C | T |
| SNP_A-2207071 | rs163183 | 2801017 | nonBB | 0.080842 | A | G |
| SNP_A-2222217 | rs231841 | 2680180 | AB | 0.041003 | A | C |
| SNP_A-2248126 | rs3819506 | 2484900 | BB | 0.043565 | A | G |
| SNP_A-2279904 | rs16928561 | 2672031 | BB | 0.222103 | A | G |
| SNP_A-2279707 | rs179407 | 2483474 | nonBB | 0.011184 | C | T |
| SNP_A-2281097 | rs1079714 | 2717317 | nonBB | 0.583124 | C | T |
| SNP_A-2286096 | rs11023094 | 2483937 | nonAB | 0.158471 | C | T |
| SNP_A-2306355 | rs17744869 | 2780438 | nonBB | 0.236986 | C | G |

[1]Official SNP nomenclature according to NCBI db SNP version 126, May 2006.
[2]Chromosomal position based on the NCBI Build 36.1, March 2006.
[3]P value of genotype having highest QT values versus all other genotypes.

Among the SNPs shown in Table 16, a genotype of TT at SNP_A-2279707 (rs179407) was shown to accurately predict a predisposition to QTc prolongation. Therefore, an individual having a genotype of TT at SNP_A-2279707 (rs179407) may be predicted to be predisposed to QTc prolongation.

Table 17 below shows the results of a study of 174 individuals, each of whom was genotyped at the rs179407 locus and their QT interval measured following the oral administration of 24 mg/day B.I.D. of iloperidone for a period of two weeks.

TABLE 17

QT Prolongation and Presence or Absence of a Genotype for SNP_A-2279707 (rs179407) Associated with a Predisposition to QT Prolongation

| Change Threshold (msec) | Low QT − test | Low QT + test | High QT − test | High QT + test | Odds Ratio | p value | sensitivity | specificity | negative predictive value | positive predictive value |
|---|---|---|---|---|---|---|---|---|---|---|
| QT > 5 | 19 | 47 | 15 | 102 | 2.748936 | 0.0091 | 0.871795 | 0.287879 | 0.558824 | 0.684564 |
| QT > 15 | 25 | 85 | 9 | 64 | 2.091503 | 0.0807 | 0.876712 | 0.227273 | 0.735294 | 0.42953 |
| QT > 30 | 32 | 123 | 2 | 26 | 3.382114 | 0.1089 | 0.928571 | 0.206452 | 0.941176 | 0.174497 |

As can be seen in Table 17, an individual's KCNQ1 sequence at the SNP_A-2279707 (rs179407) locus is highly predictive of whether the individual will experience QT prolongation following the administration of iloperidone. For example, using the lowest threshold of a change in QTc interval (between baseline and the end of the second week) greater than 5 milliseconds (normal QTc intervals are between 0.30 and 0.44 seconds for males and between 0.30 and 0.45 for females), 102 of those individuals with a SNP genotype (test is considered positive if genotype for SNP_A-2279707 (rs179407) is TT) associated with a predisposition to QT prolongation experienced QT prolongation while only 47 such individuals did not. Similarly, nearly seven times as many individuals (102) experiencing QT prolongation possessed a SNP genotype associated with a predisposition to QT prolongation as did not (15). This resulted in a sensitivity (probability that the individual will have a SNP genotype associated with a predisposition to QT prolongation, given that he/she experienced QT prolongation) of 0.87 and a specificity (probability that the individual will not have a SNP genotype associated with a predisposition to QT prolongation, given that he/she did not experience QT prolongation) of 0.29, a negative predictive value (probability that the individual will not experience QT prolongation, given that he/she does not have a SNP genotype associated with a predisposition to QT prolongation) of 0.56, and a positive predictive value (probability that the individual will experience QT prolongation, given that he/she has a SNP genotype associated with a predisposition to QT prolongation) of 0.68.

The use of higher thresholds (i.e., QTs greater than 15 and 30 milliseconds) yielded markedly increased negative predictive values (0.74 and 0.94, respectively). The associated decrease in positive predictive values, from 0.68 for QTs greater than 5 milliseconds to 0.17 for QTs greater than 30 milliseconds) suggests that additional factors affect more severe QT prolongation.

As the data in Table 17 show, an individual's KCNQ1 sequence at the SNP loci above may be used to predict whether an individual is predisposed to QT prolongation due to the administration of a compound capable of prolonging the QT interval. That is, individuals having one or more SNP genotype associated with a predisposition to QT prolongation may reliably be predicted to experience a prolonged QT interval (i.e., a QT interval prolonged by at least 5 milliseconds) following the administration of a compound capable of prolonging the QT interval. Similarly, individuals not having any of the above SNP genotypes associated with a predisposition to QT prolongation may reliably be predicted to not experience severe QT prolongation (i.e., a QT interval prolonged greater than 15 milliseconds) following the administration of a compound capable of prolonging the QT interval.

Methods according to the invention may involve direct sequencing or genotyping of an individual's KCNQ1 and/or CYP2D6 genes or the characterization of expression products of the genes. For example, as noted above, the CYP2D6G1846A polymorphism results in premature termination of the CYP2D6 protein and the CYP2D6C100T polymorphism results in the substitution of a proline at position 34 by serine. Either of these polymorphisms could be determined from the resulting proteins or RNA. Accordingly, the invention includes testing genes and/or their expression products.

The foregoing description of various aspects of the invention has been presented for purposes of illustration and description. It is not intended to be exhaustive or to limit the invention to the precise form disclosed, and obviously, many modifications and variations are possible. Such modifications and variations that may be apparent to a person skilled in the art are intended to be included within the scope of the invention as defined by the accompanying claims.

SEQUENCE LISTING (4 sequences)

SEQ ID NO: 1 - DNA, 404123 bp, Homo sapiens
  ref <302>: TITLE: Homo sapiens KVLQT1 gene
  ref <308>: DATABASE ACCESSION NUMBER: GenBank AJ006345.1
  ref <309>: DATABASE ENTRY DATE: 2006-11-14
cccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtgagggagagggcgggccaaaccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgaaaggaagcgctggggttggggccgcctgccaggcgcccggcggggcagcgcgggcctggccaaaaaatgccccttctcgctggaactggcggagggcggcccggcgggcggcgcgctctacgcgcccatcgcgcccggcgccccaggtcccgcgccccatgtgtccccggccgcgcccgccgcgcccccagttgcttccgaccttggcccgcggccgccggtgagcctagacccgcgcgtctccatatacagcacgcgccgcccggtgttggcgcgaacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtaagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatacaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacacaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaaccaaagacactggggaaaacaaaagtggggaagggggaaagggaacaaggttttaaaagttacctgtgggtgctgtgcgcactacgtgggaaaccggatcgtttggactccaaacctcagcatcatgcaaaaaacctttgtgacaaacctggacttggacctcctgaacccatttaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctccgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgattaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgcgagtgatgagggacaacatcagtcctctcttggcttctgtactttaataaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcttccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattacctctaataagtttttggggaatctttaggggtttctacatatgaaattatgtaatctgtgaatagaaatagttttacgtcttttttttccattctggatgccttttatttcttttaatttttttcttgccaaattgctctggctaaaattttcagtccaatgttgaatagaagtggtgaaagtggtcaccctggccttattcctgaccttaaagggaaaaatttcagtctcatcattatgatgttagctgtggattttcacatatggtttttattatgttaaggtagttcccttctattcctagtttgttgaaagtttttaataaggatgttgaattttgtcaaatgctttttgtatcaattgagatcatgtgatcatgtgactgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttaaaatagctgttatgagaaaactcaaattcaagataacacagcgaaggaattcagaattctatcagataaatttaataaagagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcactggtaatacatacacagaaatacaaatagtattataacactgtaattatggtgtgtaaactactcatatattaagtagaaggatgaaaagaagaactgataaataatgactacaacaacttttgcggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagtttctgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaatttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataaatagctcttgttattttgagatatgttccatcaattcctagtttattgagagtttttggcatgaagggatgttgaattttatcgaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggaggggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttttacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagatagcgccactgcagtctggcctgggcaaaagagtgagactccatctcaggaaaaataaaaaataaaaaataaaattaaaaaaaatggctaggatcacaacccctgcttttttttttttttttttttttttttgtgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtcattattttggtgtggttttgcagtggctgatactgctttttcctttccatgtttagtgcttccttcaggagctcttgtaaggcaagcctggtggtgtcaaaatccctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcattcggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccccgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacataccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtggggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggtttttttttttaaaagataaaattgacaaacctttagccagactaagaaaagaagagggaagatccaagtaactaaagtcagagacaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaatgtactcaacgtcactgatcatcagagaaatgcaaatgaaaactataatgagatatgaccccaccctggtcaatatagcttttatccaaaagataggcaataatggatgctagtgaggatgtggagaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacatgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttaggaggccgagtcatatgactcacttaaggccaggagttcgaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaccgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttatactgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttacaatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccatttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatgcgcactcctacgtttactgcggcactgttcaccggagcctgtgccttcaatgtcgtattcaagaaatcatcctcaaatccaaagtctttctattttctcctatgtgttcctattgctttaggtcttacatttatacctttgacccatattgagttaattttttatatccagctttattcttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataacttcgtaggtatggatgttcctattgttggaggtgttatcttcagggtagattcctagaaatgggagtgttgggctgaaagagaagcccgtagttttgttggatgtgaccaaatttccctgcagaacggttgcacatttgcactcccccagcaatgcatgagcataccggttttttttacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtggtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcctggtgggtcccagccccgtacatggaggctgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgaggagggctaaggaaagtcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtagggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccagtgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccagtgtggcagggacagggtgtcggtgaggcaggtggctgaggaaatggtagctgcaggttttggccccagtcccagcagcgggactatggctgtggggagggaggaacccagggagggggcctgagcaggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtaaccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaggccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggaatctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccttctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctccgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggaacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggaggaggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatacgtatatatgtgtatatatctatgtatatatatgtgtatgtatatgtatatatatgtgtatatatatgtgtatatatatgtgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctcgttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagcccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgttttgggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccgtacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacrcytataatcccarcactttgggaggccgaagcaggcagatcacctaaggtcaggagttccagaccagcctggscaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttygttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatrttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacrtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacarrmargagtccgcmrgaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgarggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccrgggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcsggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatktccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcakgccctctggggaggacaccctgcagacgaggggctccggttcccccakggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgkgcgcmtgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaargtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgargcagcagcagggtcctcctcagctgargactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttytggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtwatacagttattgacttckgcaattaaamwtcaatatwatacttggacctaatttaatgcstatggttcccattttgtcagttgccatgacaatgtcctttgtggcatwttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacacmttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacatgccaccaagcccggctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcagttgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctggatacaacattagatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaatcttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttattcttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattgtcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacctccagtactgtgttgaatagaagtggtgagaataacttgtactaggtccctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccatctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctatcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttgtttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattccttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttccctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctaatctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccatatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttcttcatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatcyccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccattgttcyttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtctttttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatccttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttgtaaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttgggtttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggagttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttytagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgtgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattgtgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtgtgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatggaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtattttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggrwwrggctgtttgtgtcctatttaagaaactttgactactccaaggtcataaagatatkctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacgtgacgggcgagggaagaggaccatggtaacttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaakgtccccacattccatggcagtgcctakgasctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgytgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacastaggacytytcttcatcatgcagccgtagagctggaggccaaggacaccctctggaaatctgaattccattcgmtcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctractggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcytcagatagggtggagagcaccccttattagagggtggttgggctctytaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcytattgcatctttccagacgtattttatataaacaaatatacgtgtgtctgtgtgtgcatgtacttagtagatacggctcctttttatacaaatggtagcatactgtatgtatttttytacactttgcctytgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcytttctgagagcacagcaatgcctactcatcytgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatytgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacctctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggaggcccagggaggaccgcgcggaggagaaccatgctgaggagcccccggggagaacagaaccgcggcgagaggcccccggagagaaccgcgccgaagaacccccggggagaaccgcgccgaagaacccccggggagaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgacttttctccccaagagaacaccaaatccatttccttgggacatggataaggctaagggcagcacccacaaggaccaggagcggggttctcaacagccatttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgaacggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggccggttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtatgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgctgggatgtggcttccgtggactgagcagcctggagcccctacttgcttggtgtcccgagccagccggacatgcatcccgctctctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggaaggagtggggcaggagggggctttgcagattacccagaccctttgttggccagtgtgggaatggggggaggccagggaggaacccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccacatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagactacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaaaaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctctaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcatgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagaccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacatgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctagggcacgtgaagccctggctggccccgagtgcggtgtggttggcgcagatggcaacagggtcactctggctgcagagccaagaatggaccactgaggggctgggacagacctggcagaccaggagggaggccgctgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccgcctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacactcacacacacactctctctctctctctctctctctctctctctctctctctctcgctctttctctctcccccctacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaggcttgtctagcgctggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtagctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgacgccctgcccggtggaggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaagaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccatgtcccacgcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgtggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggtggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacgtctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcgaggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggaccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcaagctggggttacctgacacttgtcatccttctgctgggcctcagcacccggcggagcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcagctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccatatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcagagcctgggtgcaggggcatcttgctggtgaagctggggagagacctgcgcaaccccacctgagtgaggcactgtgggcccagagtccaggtcagcgccaggggcagcaggggctggatctccggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatrttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgcycagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgaccygggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaraaaaaraaaraaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaraaaaaaaaaaaaaaaaaaaaaaaaaaccccacagctaacatcacatcacacttaatagtgaagaacagaatactttccccctaaaataaaaaaraaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcrggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacrggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacwaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatcttwaaacagatttattttrgagytgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccrcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcaatatcccatcttacagaaaggagaacagggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccttccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccagccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatataataagtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaaggggtttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattatcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgattaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccattgagaatgaagatgatgaattgttgctccttggaagacaatctgtcttttttctccggcggcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactaatatattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtgttgaatgtggatggcagggaccatacgggatagcacactccagtagttgccaactcatggccccagtgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacaaccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagaggtcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcaactccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcccggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctttccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaagtgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttcttttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagaaggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaacgtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgatcttcccctaacccctaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtcccyttccccacgtggtaattctggactgttcacagtggcttccaaggcctttgggatgggccttgcktkctrcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcakccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaasgccccaaggcaggaargaataggcctggtctgtgggtctgagaggatggagagggctgaacacgggccaaaggagaaagttagggagggaaggtggagtccytggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgrgagtggagmtgggcatgcacamtaaggcctggaggctkrtgmttatcsatmatatagcaggcstgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggmtacgcagaggccctgggaggagggaggctaggcccaggggtggaaagaagacagatacgagaggggatttggagacacaatccccagacttggggacgagctggatatggtggygawggaggkgagtcttcaggamagacccccwggttctggcttggccatatgttggaggctgaaacgattcatccagacaggagcagggaggaggacatgcagggcctgaaagkttctgaggtgtccacgtggaggtgtttgcyyggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcarggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcargttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggmtggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacytcagcaggcakggactagcacccaagaagamaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtrggtggggcaggagctctygtgatgaaaacaacagggattcagtaaatgcattcmakctaaaaaggaagamctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggarggggargaggatgagaaggaaggaggagggargaggaaggaagagggaggaggaaggaggaggaargaggaggaaggaggagggaggargaaggargagrgwkgagggaggaagagagagaaggwagagattggccaaaggagctctgagaggggaaggtgggtgcatgccaccctggctgggaacagcaggtgtgtggtgaaggggaaagaccagcaggccctttacaccgtgggcacaggctcaggactggctgcggtgctacgcaggagccctctgactagctggggctggggctktgcaggataaggccagtgagagaagaggaytcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccascacccctgagggaaggcctggcccctcasgcacartkggggttgcccggcatcttggcagatgggcagcgttagagaagccttggacctgggcccttgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggarcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctmagggccccgccaggtgaaggaacaagcttggaagggtgtcsttatgtmtgagagttggggagacacccccaagccccagatgggcytcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggaggscgsccytstcytgggtgcaggccmgggggctgggggctgcccgcccgtytkggtyarccgsarstgccaamccgsccctggckgagtyakkgggcctycatytycmrgcctkgcttgaggtgggaatagcagtgaggttggacatccaggcacctggarggtgggcagggctccctgcggctggggtggccagtggcacctggctgttgcccccctgcaccccagccctttggcccccaagtstctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcakcgggctcascctgcaktgtccaggagcgacgggaagcctcgtggggctgttgggagacagcaagacctgggtcagcagagcaccgtgtggggtaagcagatgacagggcagtgacagggtgattcggscccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcstgtggagccctcagcytccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcarccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgccccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactcccyggcccctccctgctcgagaggtgaccaaggcccagggtctcccagcgagcaagaggccattgaactgttgttggctgtgcagtgccctgccctcggggaggcsgcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtsatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagraggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgcwggggtcctaggggctggtgcaaytcagaggttccagatggcccagcaagtggctgagggcccagggtaggggaggatgtgggggcagcagggccgatgtgggcagacstggagcaatgacacgagaacggccaggcagccctgggyttyccctgcccacctgcccccgtggccgggytggggtttggctgaggcagcagagcgctcgctggctgcccgaacaaagtgttctgcctggtgtcccctggcamtccgggcytctgcgggctcgccagagggggcagctcaggaggcagcggcagagaatcaaatgcaggtggggcstgtgcccaccgccagcacaaacacggmtcmtgggcccccagcctgccsgamgttcctgcccgcctggcccccaaacagaggccgatgggacgagccctgcccggggttgcactaggtgggcaggtgggcaggtgggcagctgcctcgggytyttggacagagccgcccctgcctggcgtctgccggcaggaagctcctgaggccgggctagggataggccagcccttgggggaggctcgagaccccatcccagcctggggcttccccaccccytcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcakcctctgcaggtctgtgaggctgtggatgtgacagctctggctctggcacaaacgtcagccccaacccasatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctstggtggctggagccagctgggggagggaaggcagcaggggmtgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggaaggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcgtgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagatgacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcatgcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcatagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttctcacaagggggcggcaccatgatgcatcaaactgtggaaccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgttacgctctcgtaggtctctgggcgtcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccgttccccttcccagaggccccgccccaccctgccttttgctttcgccggctcctaacttgacacactgtgtccccccatatggcagctccgtggtctcgagatggagccttggggtgggagctgtggggacaggatgggagacatggcactttcagccagtgactctgaccttcttttcctgggcctcagtgtctgcatctgtgggatggagtgtgggcctctgtggctcgtccccaagtggctttgcagagcactgaagtgctggcgggtccttgggtgtgagagaccccggtggatggccgtgggcccttgcccgtgccaaaccacagaagtcctgcacccctttcttccatagtgtgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcaacctctcacagcaccctgttggccgcctcttccttagcctgctcagcctccgtggtaggtgctgtgggtgaccaccacagcacccaacccttgaagctggcccgggtccacccagaccctagcaaactggttggaccctctctggccatcccggggcttgtgcccaccttcacccagcagcatcttccctggggttgttctcacccgcacagaacccagccttggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccttgagcctgaatgcctgtggacacatatagggactcccagcacgcacgggatggattccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccaccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttaaggacgtcgctcctgttctgggccctggggctggccct

SEQ ID NO: 2 - DNA, 404123 bp, Homo sapiens
cccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtgagggagagggcgggccaaaccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgaaaggaagcgctggggttggggccgcctgccaggcgcccggcggggcagcgcgggcctggccaaaaaatgccccttctcgctggaactggcggagggcggcccggcgggcggcgcgctctacgcgcccatcgcgcccggcgccccaggtcccgcgccccatgtgtccccggccgcgcccgccgcgcccccagttgcttccgaccttggcccgcggccgccggtgagcctagacccgcgcgtctccatatacagcacgcgccgcccggtgttggcgcgaacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtaagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatacaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacacaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaaccaaagacactggggaaaacaaaagtggggaagggggaaagggaacaaggttttaaaagttacctgtgggtgctgtgcgcactacgtgggaaaccggatcgtttggactccaaacctcagcatcatgcaaaaaacctttgtgacaaacctggacttggacctcctgaacccatttaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctccgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgattaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgcgagtgatgagggacaacatcagtcctctcttggcttctgtactttaataaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcttccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattacctctaataagtttttggggaatctttaggggtttctacatatgaaattatgtaatctgtgaatagaaatagttttacgtcttttttttccattctggatgccttttatttcttttaatttttttcttgccaaattgctctggctaaaattttcagtccaatgttgaatagaagtggtgaaagtggtcaccctggccttattcctgaccttaaagggaaaaatttcagtctcatcattatgatgttagctgtggattttcacatatggtttttattatgttaaggtagttcccttctattcctagtttgttgaaagtttttaataaggatgttgaattttgtcaaatgctttttgtatcaattgagatcatgtgatcatgtgactgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttaaaatagctgttatgagaaaactcaaattcaagataacacagcgaaggaattcagaattctatcagataaatttaataaagagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcactggtaatacatacacagaaatacaaatagtattataacactgtaattatggtgtgtaaactactcatatattaagtagaaggatgaaaagaagaactgataaataatgactacaacaacttttgcggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagtttctgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaatttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataaatagctcttgttattttgagatatgttccatcaattcctagtttattgagagtttttggcatgaagggatgttgaattttatcgaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggaggggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttttacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagatagcgccactgcagtctggcctgggcaaaagagtgagactccatctcaggaaaaataaaaaataaaaaataaaattaaaaaaaatggctaggatcacaacccctgcttttttttttttttttttttttttttgtgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtcattattttggtgtggttttgcagtggctgatactgctttttcctttccatgtttagtgcttccttcaggagctcttgtaaggcaagcctggtggtgtcaaaatccctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcattcggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccccgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacataccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtggggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggtttttttttttaaaagataaaattgacaaacctttagccagactaagaaaagaagagggaagatccaagtaactaaagtcagagacaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaatgtactcaacgtcactgatcatcagagaaatgcaaatgaaaactataatgagatatgaccccaccctggtcaatatagcttttatccaaaagataggcaataatggatgctagtgaggatgtggagaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacatgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttaggaggccgagtcatatgactcacttaaggccaggagttcgaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaccgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttatactgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttacaatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccatttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatgcgcactcctacgtttactgcggcactgttcaccggagcctgtgccttcaatgtcgtattcaagaaatcatcctcaaatccaaagtctttctattttctcctatgtgttcctattgctttaggtcttacatttatacctttgacccatattgagttaattttttatatccagctttattcttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataacttcgtaggtatggatgttcctattgttggaggtgttatcttcagggtagattcctagaaatgggagtgttgggctgaaagagaagcccgtagttttgttggatgtgaccaaatttccctgcagaacggttgcacatttgcactcccccagcaatgcatgagcataccggttttttttacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtggtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcctggtgggtcccagccccgtacatggaggctgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgaggagggctaaggaaagtcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtagggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccagtgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggccccgttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccagtgtggcagggacagggtgtcggtgaggcaggtggctgaggaaatggtagctgcaggttttggccccagtcccagcagcgggactatggctgtggggagggaggaacccagggagggggcctgagcaggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtaaccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaggccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggaatctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccttctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctccgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggaacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggaggaggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatacgtatatatgtgtatatatctatgtatatatatgtgtatgtatatgtatatatatgtgtatatatatgtgtatatatatgtgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctcgttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagcccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgttttgggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccgtacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacrcytataatcccarcactttgggaggccgaagcaggcagatcacctaaggtcaggagttccagaccagcctggscaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttygttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatrttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacrtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacarrmargagtccgcmrgaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgarggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccrgggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcsggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatktccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcakgccctctggggaggacaccctgcagacgaggggctccggttcccccakggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgkgcgcmtgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaargtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgargcagcagcagggtcctcctcagctgargactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttytggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtwatacagttattgacttckgcaattaaamwtcaatatwatacttggacctaatttaatgcstatggttcccattttgtcagttgccatgacaatgtcctttgtggcatwttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacacmttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacatgccaccaagcccggctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcagttgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctggatacaacattagatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaatcttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttattcttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattgtcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacctccagtactgtgttgaatagaagtggtgagaataacttgtactaggtccctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccatctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctatcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttgtttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattccttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttccctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctaatctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccatatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttcttcatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatcyccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccattgttcyttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtctttttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatccttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttgtaaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttgggtttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggagttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttytagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgtgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattgtgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtgtgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatggaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtattttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggrwwrggctgtttgtgtcctatttaagaaactttgactactccaaggtcataaagatatkctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacgtgacgggcgagggaagaggaccatggtaacttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaakgtccccacattccatggcagtgcctakgasctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgytgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacastaggacytytcttcatcatgcagccgtagagctggaggccaaggacaccctctggaaatctgaattccattcgmtcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctractggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcytcagatagggtggagagcaccccttattagagggtggttgggctctytaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcytattgcatctttccagacgtattttatataaacaaatatacgtgtgtctgtgtgtgcatgtacttagtagatacggctcctttttatacaaatggtagcatactgtatgtatttttytacactttgcctytgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcytttctgagagcacagcaatgcctactcatcytgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatytgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacctctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggaggcccagggaggaccgcgcggaggagaaccatgctgaggagcccccggggagaacagaaccgcggcgagaggcccccggagagaaccgcgccgaagaacccccggggagaaccgcgccgaagaacccccggggagaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgacttttctccccaagagaacaccaaatccatttccttgggacatggataaggctaagggcagcacccacaaggaccaggagcggggttctcaacagccatttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgaacggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggccggttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtatgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgctgggatgtggcttccgtggactgagcagcctggagcccctacttgcttggtgtcccgagccagccggacatgcatcccgctctctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggaaggagtggggcaggagggggctttgcagattacccagaccctttgttggccagtgtgggaatggggggaggccagggaggaacccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccacatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagactacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaaaaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctctaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcatgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagaccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacatgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctagggcacgtgaagccctggctggccccgagtgcggtgtggttggcgcagatggcaacagggtcactctggctgcagagccaagaatggaccactgaggggctgggacagacctggcagaccaggagggaggccgctgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccgcctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacactcacacacacactctctctctctctctctctctctctctctctctctctctctcgctctttctctctcccccctacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaggcttgtctagcgctggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtagctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgacgccctgcccggtggaggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaagaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccatgtcccacgcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgtggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggtggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacgtctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcgaggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggaccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcaagctggggttacctgacacttgtcatccttctgctgggcctcagcacccggcggagcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcagctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccatatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcagagcctgggtgcaggggcatcttgctggtgaagctggggagagacctgcgcaaccccacctgagtgaggcactgtgggcccagagtccaggtcagcgccaggggcagcaggggctggatctccggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatrttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgcycagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgaccygggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaraaaaaraaaraaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaraaaaaaaaaaaaaaaaaaaaaaaaaaccccacagctaacatcacatcacacttaatagtgaagaacagaatactttccccctaaaataaaaaaraaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcrggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacrggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacwaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatcttwaaacagatttattttrgagytgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccrcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcaatatcccatcttacagaaaggagaacagggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccttccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccagccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatataataagtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaaggggtttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattatcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgattaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccattgagaatgaagatgatgaattgttgctccttggaagacaatctgtcttttttctccggcggcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactaatatattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtgttgaatgtggatggcagggaccatacgggatagcacactccagtagttgccaactcatggccccagtgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacaaccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagaggtcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcaactccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcccggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctttccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaagtgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttcttttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagaaggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaacgtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgatcttcccctaacccctaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtcccyttccccacgtggtaattctggactgttcacagtggcttccaaggcctttgggatgggccttgcktkctrcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcakccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaasgccccaaggcaggaargaataggcctggtctgtgggtctgagaggatggagagggctgaacacgggccaaaggagaaagttagggagggaaggtggagtccytggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgrgagtggagmtgggcatgcacamtaaggcctggaggctkrtgmttatcsatmatatagcaggcstgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggmtacgcagaggccctgggaggagggaggctaggcccaggggtggaaagaagacagatacgagaggggatttggagacacaatccccagacttggggacgagctggatatggtggygawggaggkgagtcttcaggamagacccccwggttctggcttggccatatgttggaggctgaaacgattcatccagacaggagcagggaggaggacatgcagggcctgaaagkttctgaggtgtccacgtggaggtgtttgcyyggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcarggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcargttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggmtggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacytcagcaggcakggactagcacccaagaagamaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtrggtggggcaggagctctygtgatgaaaacaacagggattcagtaaatgcattcmakctaaaaaggaagamctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggarggggargaggatgagaaggaaggaggagggargaggaaggaagagggaggaggaaggaggaggaargaggaggaaggaggagggaggargaaggargagrgwkgagggaggaagagagagaaggwagagattggccaaaggagctctgagaggggaaggtgggtgcatgccaccctggctgggaacagcaggtgtgtggtgaaggggaaagaccagcaggccctttacaccgtgggcacaggctcaggactggctgcggtgctacgcaggagccctctgactagctggggctggggctktgcaggataaggccagtgagagaagaggaytcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccascacccctgagggaaggcctggcccctcasgcacartkggggttgcccggcatcttggcagatgggcagcgttagagaagccttggacctgggcccttgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggarcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctmagggccccgccaggtgaaggaacaagcttggaagggtgtcsttatgtmtgagagttggggagacacccccaagccccagatgggcytcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggaggscgsccytstcytgggtgcaggccmgggggctgggggctgcccgcccgtytkggtyarccgsarstgccaamccgsccctggckgagtyakkgggcctycatytycmrgcctkgcttgaggtgggaatagcagtgaggttggacatccaggcacctggarggtgggcagggctccctgcggctggggtggccagtggcacctggctgttgcccccctgcaccccagccctttggcccccaagtstctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcakcgggctcascctgcaktgtccaggagcgacgggaagcctcgtggggctgttgggagacagcaagacctgggtcagcagagcaccgtgtggggtaagcagatgacagggcagtgacagggtgattcggscccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcstgtggagccctcagcytccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcarccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgccccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactcccyggcccctccctgctcgagaggtgaccaaggcccagggtctcccagcgagcaagaggccattgaactgttgttggctgtgcagtgccctgccctcggggaggcsgcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtsatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagraggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgcwggggtcctaggggctggtgcaaytcagaggttccagatggcccagcaagtggctgagggcccagggtaggggaggatgtgggggcagcagggccgatgtgggcagacstggagcaatgacacgagaacggccaggcagccctgggyttyccctgcccacctgcccccgtggccgggytggggtttggctgaggcagcagagcgctcgctggctgcccgaacaaagtgttctgcctggtgtcccctggcamtccgggcytctgcgggctcgccagagggggcagctcaggaggcagcggcagagaatcaaatgcaggtggggcstgtgcccaccgccagcacaaacacggmtcmtgggcccccagcctgccsgamgttcctgcccgcctggcccccaaacagaggccgatgggacgagccctgcccggggttgcactaggtgggcaggtgggcaggtgggcagctgcctcgggytyttggacagagccgcccctgcctggcgtctgccggcaggaagctcctgaggccgggctagggataggccagcccttgggggaggctcgagaccccatcccagcctggggcttccccaccccytcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcakcctctgcaggtctgtgaggctgtggatgtgacagctctggctctggcacaaacgtcagccccaacccasatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctstggtggctggagccagctgggggagggaaggcagcaggggmtgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggaaggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcgtgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagatgacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcatgcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcatagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttctcacaagggggcggcaccatgatgcatcaaactgtggaaccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgttacgctctcgtaggtctctgggcgtcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccgttccccttcccagaggccccgccccaccctgccttttgctttcgccggctcctaacttgacacactgtgtccccccatatggcagctccgtggtctcgagatggagccttggggtgggagctgtggggacaggatgggagacatggcactttcagccagtgactctgaccttcttttcctgggcctcagtgtctgcatctgtgggatggagtgtgggcctctgtggctcgtccccaagtggctttgcagagcactgaagtgctggcgggtccttgggtgtgagagaccccggtggatggccgtgggcccttgcccgtgccaaaccacagaagtcctgcacccctttcttccatagtgtgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcaacctctcacagcaccctgttggccgcctcttccttagcctgctcagcctccgtggtaggtgctgtgggtgaccaccacagcacccaacccttgaagctggcccgggtccacccagaccctagcaaactggttggaccctctctggccatcccggggcttgtgcccaccttcacccagcagcatcttccctggggttgttctcacccgcacagaacccagccttggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccttgagcctgaatgcctgtggacacatatagggactcccagcacgcacgggatggattccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccaccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttaaggacgtcgctcctgttctgggccctggggctggccct

SEQ ID NO: 3 - DNA, 404123 bp, Homo sapiens
cccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtgagggagagggcgggccaaaccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgaaaggaagcgctggggttggggccgcctgccaggcgcccggcggggcagcgcgggcctggccaaaaaatgccccttctcgctggaactggcggagggcggcccggcgggcggcgcgctctacgcgcccatcgcgcccggcgccccaggtcccgcgccccatgtgtccccggccgcgcccgccgcgcccccagttgcttccgaccttggcccgcggccgccggtgagcctagacccgcgcgtctccatatacagcacgcgccgcccggtgttggcgcgaacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtaagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatacaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacacaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaaccaaagacactggggaaaacaaaagtggggaagggggaaagggaacaaggttttaaaagttacctgtgggtgctgtgcgcactacgtgggaaaccggatcgtttggactccaaacctcagcatcatgcaaaaaacctttgtgacaaacctggacttggacctcctgaacccatttaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctccgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgattaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgcgagtgatgagggacaacatcagtcctctcttggcttctgtactttaataaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcttccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattacctctaataagtttttggggaatctttaggggtttctacatatgaaattatgtaatctgtgaatagaaatagttttacgtcttttttttccattctggatgccttttatttcttttaatttttttcttgccaaattgctctggctaaaattttcagtccaatgttgaatagaagtggtgaaagtggtcaccctggccttattcctgaccttaaagggaaaaatttcagtctcatcattatgatgttagctgtggattttcacatatggtttttattatgttaaggtagttcccttctattcctagtttgttgaaagtttttaataaggatgttgaattttgtcaaatgctttttgtatcaattgagatcatgtgatcatgtgactgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttaaaatagctgttatgagaaaactcaaattcaagataacacagcgaaggaattcagaattctatcagataaatttaataaagagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcactggtaatacatacacagaaatacaaatagtattataacactgtaattatggtgtgtaaactactcatatattaagtagaaggatgaaaagaagaactgataaataatgactacaacaacttttgcggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagtttctgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaatttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataaatagctcttgttattttgagatatgttccatcaattcctagtttattgagagtttttggcatgaagggatgttgaattttatcgaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggaggggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttttacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagatagcgccactgcagtctggcctgggcaaaagagtgagactccatctcaggaaaaataaaaaataaaaaataaaattaaaaaaaatggctaggatcacaacccctgcttttttttttttttttttttttttttgtgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtcattattttggtgtggttttgcagtggctgatactgctttttcctttccatgtttagtgcttccttcaggagctcttgtaaggcaagcctggtggtgtcaaaatccctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcattcggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccccgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacataccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtggggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggtttttttttttaaaagataaaattgacaaacctttagccagactaagaaaagaagagggaagatccaagtaactaaagtcagagacaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaatgtactcaacgtcactgatcatcagagaaatgcaaatgaaaactataatgagatatgaccccaccctggtcaatatagcttttatccaaaagataggcaataatggatgctagtgaggatgtggagaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacatgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttaggaggccgagtcatatgactcacttaaggccaggagttcgaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaccgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttatactgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttacaatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccatttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatgcgcactcctacgtttactgcggcactgttcaccggagcctgtgccttcaatgtcgtattcaagaaatcatcctcaaatccaaagtctttctattttctcctatgtgttcctattgctttaggtcttacatttatacctttgacccatattgagttaattttttatatccagctttattcttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataacttcgtaggtatggatgttcctattgttggaggtgttatcttcagggtagattcctagaaatgggagtgttgggctgaaagagaagcccgtagttttgttggatgtgaccaaatttccctgcagaacggttgcacatttgcactcccccagcaatgcatgagcataccggttttttttacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtggtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcctggtgggtcccagccccgtacatggaggctgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgaggagggctaaggaaagtcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtagggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccagtgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccagtgtggcagggacagggtgtcggtgaggcaggtggctgaggaaatggtagctgcaggttttggccccagtcccagcagcgggactatggctgtggggagggaggaacccagggagggggcctgagcaggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtaaccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaggccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggaatctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccttctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctccgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggaacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggaggaggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatacgtatatatgtgtatatatctatgtatatatatgtgtatgtatatgtatatatatgtgtatatatatgtgtatatatatgtgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctcgttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagcccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgttttgggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccgtacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacrcytataatcccarcactttgggaggccgaagcaggcagatcacctaaggtcaggagttccagaccagcctggscaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttygttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatrttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacrtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacarrmargagtccgcmrgaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgarggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccrgggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcsggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatktccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcakgccctctggggaggacaccctgcagacgaggggctccggttcccccakggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgkgcgcmtgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaargtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgargcagcagcagggtcctcctcagctgargactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttytggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtwatacagttattgacttckgcaattaaamwtcaatatwatacttggacctaatttaatgcstatggttcccattttgtcagttgccatgacaatgtcctttgtggcatwttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacacmttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacatgccaccaagcccggctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcagttgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctggatacaacattagatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaatcttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttattcttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattgtcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacctccagtactgtgttgaatagaagtggtgagaataacttgtactaggtccctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccatctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctatcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttgtttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattccttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttccctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctaatctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccatatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttcttcatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatcyccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccattgttcyttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtctttttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatccttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttgtaaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttgggtttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggagttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttytagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgtgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattgtgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtgtgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatggaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtattttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggrwwrggctgtttgtgtcctatttaagaaactttgactactccaaggtcataaagatatkctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacgtgacgggcgagggaagaggaccatggtaacttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaakgtccccacattccatggcagtgcctakgasctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgytgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacastaggacytytcttcatcatgcagccgtagagctggaggccaaggacaccctctggaaatctgaattccattcgmtcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctractggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcytcagatagggtggagagcaccccttattagagggtggttgggctctytaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcytattgcatctttccagacgtattttatataaacaaatatacgtgtgtctgtgtgtgcatgtacttagtagatacggctcctttttatacaaatggtagcatactgtatgtatttttytacactttgcctytgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcytttctgagagcacagcaatgcctactcatcytgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatytgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacctctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggaggcccagggaggaccgcgcggaggagaaccatgctgaggagcccccggggagaacagaaccgcggcgagaggcccccggagagaaccgcgccgaagaacccccggggagaaccgcgccgaagaacccccggggagaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgacttttctccccaagagaacaccaaatccatttccttgggacatggataaggctaagggcagcacccacaaggaccaggagcggggttctcaacagccatttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgaacggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggccggttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtatgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgctgggatgtggcttccgtggactgagcagcctggagcccctacttgcttggtgtcccgagccagccggacatgcatcccgctctctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggaaggagtggggcaggagggggctttgcagattacccagaccctttgttggccagtgtgggaatggggggaggccagggaggaacccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccacatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagactacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaaaaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctctaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcatgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagaccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacatgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctagggcacgtgaagccctggctggccccgagtgcggtgtggttggcgcagatggcaacagggtcactctggctgcagagccaagaatggaccactgaggggctgggacagacctggcagaccaggagggaggccgctgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccgcctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttggtgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacactcacacacacactctctctctctctctctctctctctctctctctctctctctcgctctttctctctcccccctacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaggcttgtctagcgctggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtagctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgacgccctgcccggtggaggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaagaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccatgtcccacgcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgtggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggtggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacgtctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcgaggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggaccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcaagctggggttacctgacacttgtcatccttctgctgggcctcagcacccggcggagcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcagctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccatatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcagagcctgggtgcaggggcatcttgctggtgaagctggggagagacctgcgcaaccccacctgagtgaggcactgtgggcccagagtccaggtcagcgccaggggcagcaggggctggatctccggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatrttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgcycagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgaccygggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaraaaaaraaaraaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaraaaaaaaaaaaaaaaaaaaaaaaaaaccccacagctaacatcacatcacacttaatagtgaagaacagaatactttccccctaaaataaaaaaraaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcrggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacrggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacwaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatcttwaaacagatttattttrgagytgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccrcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcaatatcccatcttacagaaaggagaacagggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccttccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccagccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatataataagtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaaggggtttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattatcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgattaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccattgagaatgaagatgatgaattgttgctccttggaagacaatctgtcttttttctccggcggcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactaatatattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtgttgaatgtggatggcagggaccatacgggatagcacactccagtagttgccaactcatggccccagtgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacaaccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagaggtcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcaactccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcccggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctttccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaagtgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttcttttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagaaggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaacgtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgatcttcccctaacccctaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtcccyttccccacgtggtaattctggactgttcacagtggcttccaaggcctttgggatgggccttgcktkctrcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcakccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaasgccccaaggcaggaargaataggcctggtctgtgggtctgagaggatggagagggctgaacacgggccaaaggagaaagttagggagggaaggtggagtccytggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgrgagtggagmtgggcatgcacamtaaggcctggaggctkrtgmttatcsatmatatagcaggcstgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggmtacgcagaggccctgggaggagggaggctaggcccaggggtggaaagaagacagatacgagaggggatttggagacacaatccccagacttggggacgagctggatatggtggygawggaggkgagtcttcaggamagacccccwggttctggcttggccatatgttggaggctgaaacgattcatccagacaggagcagggaggaggacatgcagggcctgaaagkttctgaggtgtccacgtggaggtgtttgcyyggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcarggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcargttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggmtggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacytcagcaggcakggactagcacccaagaagamaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtrggtggggcaggagctctygtgatgaaaacaacagggattcagtaaatgcattcmakctaaaaaggaagamctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggarggggargaggatgagaaggaaggaggagggargaggaaggaagagggaggaggaaggaggaggaargaggaggaaggaggagggaggargaaggargagrgwkgagggaggaagagagagaaggwagagattggccaaaggagctctgagaggggaaggtgggtgcatgccaccctggctgggaacagcaggtgtgtggtgaaggggaaagaccagcaggccctttacaccgtgggcacaggctcaggactggctgcggtgctacgcaggagccctctgactagctggggctggggctktgcaggataaggccagtgagagaagaggaytcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccascacccctgagggaaggcctggcccctcasgcacartkggggttgcccggcatcttggcagatgggcagcgttagagaagccttggacctgggcccttgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggarcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctmagggccccgccaggtgaaggaacaagcttggaagggtgtcsttatgtmtgagagttggggagacacccccaagccccagatgggcytcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggaggscgsccytstcytgggtgcaggccmgggggctgggggctgcccgcccgtytkggtyarccgsarstgccaamccgsccctggckgagtyakkgggcctycatytycmrgcctkgcttgaggtgggaatagcagtgaggttggacatccaggcacctggarggtgggcagggctccctgcggctggggtggccagtggcacctggctgttgcccccctgcaccccagccctttggcccccaagtstctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcakcgggctcascctgcaktgtccaggagcgacgggaagcctcgtggggctgttgggagacagcaagacctgggtcagcagagcaccgtgtggggtaagcagatgacagggcagtgacagggtgattcggscccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcstgtggagccctcagcytccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcarccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgccccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactcccyggcccctccctgctcgagaggtgaccaaggcccagggtctcccagcgagcaagaggccattgaactgttgttggctgtgcagtgccctgccctcggggaggcsgcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtsatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagraggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgcwggggtcctaggggctggtgcaaytcagaggttccagatggcccagcaagtggctgagggcccagggtaggggaggatgtgggggcagcagggccgatgtgggcagacstggagcaatgacacgagaacggccaggcagccctgggyttyccctgcccacctgcccccgtggccgggytggggtttggctgaggcagcagagcgctcgctggctgcccgaacaaagtgttctgcctggtgtcccctggcamtccgggcytctgcgggctcgccagagggggcagctcaggaggcagcggcagagaatcaaatgcaggtggggcstgtgcccaccgccagcacaaacacggmtcmtgggcccccagcctgccsgamgttcctgcccgcctggcccccaaacagaggccgatgggacgagccctgcccggggttgcactaggtgggcaggtgggcaggtgggcagctgcctcgggytyttggacagagccgcccctgcctggcgtctgccggcaggaagctcctgaggccgggctagggataggccagcccttgggggaggctcgagaccccatcccagcctggggcttccccaccccytcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcakcctctgcaggtctgtgaggctgtggatgtgacagctctggctctggcacaaacgtcagccccaacccasatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctstggtggctggagccagctgggggagggaaggcagcaggggmtgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggaaggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcgtgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagatgacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcatgcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcatagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttctcacaagggggcggcaccatgatgcatcaaactgtggaaccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgttacgctctcgtaggtctctgggcgtcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccgttccccttcccagaggccccgccccaccctgccttttgctttcgccggctcctaacttgacacactgtgtccccccatatggcagctccgtggtctcgagatggagccttggggtgggagctgtggggacaggatgggagacatggcactttcagccagtgactctgaccttcttttcctgggcctcagtgtctgcatctgtgggatggagtgtgggcctctgtggctcgtccccaagtggctttgcagagcactgaagtgctggcgggtccttgggtgtgagagaccccggtggatggccgtgggcccttgcccgtgccaaaccacagaagtcctgcacccctttcttccatagtgtgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcaacctctcacagcaccctgttggccgcctcttccttagcctgctcagcctccgtggtaggtgctgtgggtgaccaccacagcacccaacccttgaagctggcccgggtccacccagaccctagcaaactggttggaccctctctggccatcccggggcttgtgcccaccttcacccagcagcatcttccctggggttgttctcacccgcacagaacccagccttggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccttgagcctgaatgcctgtggacacatatagggactcccagcacgcacgggatggattccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccaccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttaaggacgtcgctcctgttctgggccctggggctggccct

SEQ ID NO: 4 - DNA, 404123 bp, Homo sapiens
cccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtgagggagagggcgggccaaaccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgaaaggaagcgctggggttggggccgcctgccaggcgcccggcggggcagcgcgggcctggccaaaaaatgccccttctcgctggaactggcggagggcggcccggcgggcggcgcgctctacgcgcccatcgcgcccggcgccccaggtcccgcgccccatgtgtccccggccgcgcccgccgcgcccccagttgcttccgaccttggcccgcggccgccggtgagcctagacccgcgcgtctccatatacagcacgcgccgcccggtgttggcgcgaacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtaagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatacaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacacaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaaccaaagacactggggaaaacaaaagtggggaagggggaaagggaacaaggttttaaaagttacctgtgggtgctgtgcgcactacgtgggaaaccggatcgtttggactccaaacctcagcatcatgcaaaaaacctttgtgacaaacctggacttggacctcctgaacccatttaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctccgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgattaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgcgagtgatgagggacaacatcagtcctctcttggcttctgtactttaataaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcttccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattacctctaataagtttttggggaatctttaggggtttctacatatgaaattatgtaatctgtgaatagaaatagttttacgtcttttttttccattctggatgccttttatttcttttaatttttttcttgccaaattgctctggctaaaattttcagtccaatgttgaatagaagtggtgaaagtggtcaccctggccttattcctgaccttaaagggaaaaatttcagtctcatcattatgatgttagctgtggattttcacatatggtttttattatgttaaggtagttcccttctattcctagtttgttgaaagtttttaataaggatgttgaattttgtcaaatgctttttgtatcaattgagatcatgtgatcatgtgactgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttaaaatagctgttatgagaaaactcaaattcaagataacacagcgaaggaattcagaattctatcagataaatttaataaagagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcactggtaatacatacacagaaatacaaatagtattataacactgtaattatggtgtgtaaactactcatatattaagtagaaggatgaaaagaagaactgataaataatgactacaacaacttttgcggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagtttctgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaatttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataaatagctcttgttattttgagatatgttccatcaattcctagtttattgagagtttttggcatgaagggatgttgaattttatcgaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggaggggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttttacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagatagcgccactgcagtctggcctgggcaaaagagtgagactccatctcaggaaaaataaaaaataaaaaataaaattaaaaaaaatggctaggatcacaacccctgcttttttttttttttttttttttttttgtgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtcattattttggtgtggttttgcagtggctgatactgctttttcctttccatgtttagtgcttccttcaggagctcttgtaaggcaagcctggtggtgtcaaaatccctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcattcggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccccgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacataccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtggggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggtttttttttttaaaagataaaattgacaaacctttagccagactaagaaaagaagagggaagatccaagtaactaaagtcagagacaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaatgtactcaacgtcactgatcatcagagaaatgcaaatgaaaactataatgagatatgaccccaccctggtcaatatagcttttatccaaaagataggcaataatggatgctagtgaggatgtggagaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacatgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttaggaggccgagtcatatgactcacttaaggccaggagttcgaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaccgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttatactgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttacaatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccatttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatgcgcactcctacgtttactgcggcactgttcaccggagcctgtgccttcaatgtcgtattcaagaaatcatcctcaaatccaaagtctttctattttctcctatgtgttcctattgctttaggtcttacatttatacctttgacccatattgagttaattttttatatccagctttattcttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataacttcgtaggtatggatgttcctattgttggaggtgttatcttcagggtagattcctagaaatgggagtgttgggctgaaagagaagcccgtagttttgttggatgtgaccaaatttccctgcagaacggttgcacatttgcactcccccagcaatgcatgagcataccggttttttttacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtggtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcctggtgggtcccagccccgtacatggaggctgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgaggagggctaaggaaagtcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtagggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccagtgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagcccgctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccagtgtggcagggacagggtgtcggtgaggcaggtggctgaggaaatggtagctgcaggttttggccccagtcccagcagcgggactatggctgtggggagggaggaacccagggagggggcctgagcaggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtaaccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaggccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggaatctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccttctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctccgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggaacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggaggaggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatacgtatatatgtgtatatatctatgtatatatatgtgtatgtatatgtatatatatgtgtatatatatgtgtatatatatgtgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctcgttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagcccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgttttgggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccgtacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacrcytataatcccarcactttgggaggccgaagcaggcagatcacctaaggtcaggagttccagaccagcctggscaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttygttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatrttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacrtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacarrmargagtccgcmrgaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgarggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccrgggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcsggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatktccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcakgccctctggggaggacaccctgcagacgaggggctccggttcccccakggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgkgcgcmtgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaargtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgargcagcagcagggtcctcctcagctgargactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttytggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtwatacagttattgacttckgcaattaaamwtcaatatwatacttggacctaatttaatgcstatggttcccattttgtcagttgccatgacaatgtcctttgtggcatwttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacacmttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacatgccaccaagcccggctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcagttgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctggatacaacattagatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaatcttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttattcttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattgtcctttgaatatatatccagtaatgggattgctgggtcagatggtagttctgtttttagttatttgagaaaactccaaactgcttagcacagtggctgaactaatttgtatttctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacctccagtactgtgttgaatagaagtggtgagaataacttgtactaggtccctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccatctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctatcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatggggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttcttttttcttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttgtttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattccttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttccctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctaatctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccatatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttcttcatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctaaggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctgtttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatcyccacccacccacccccagctcccctccatgctctcctagatgcctgacctggctacgaccacaggtgaaaacagggaagaggtggcagctctggtgactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccattgttcyttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtctttttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatccttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttgtaaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttgggtttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggagttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttytagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgtgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattgtgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtgtgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatggaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtattttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggrwwrggctgtttgtgtcctatttaagaaactttgactactccaaggtcataaagatatkctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctccccactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacgtgacgggcgagggaagaggaccatggtaacttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaakgtccccacattccatggcagtgcctakgasctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgytgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagatccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacastaggacytytcttcatcatgcagccgtagagctggaggccaaggacaccctctggaaatctgaattccattcgmtcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaagctcactgggcaccttggctgcagggtctgaaaagtcctttgtgttagctccagctgcagagtttttccaggcctcgcttctggggctractggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcytcagatagggtggagagcaccccttattagagggtggttgggctctytaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcytattgcatctttccagacgtattttatataaacaaatatacgtgtgtctgtgtgtgcatgtacttagtagatacggctcctttttatacaaatggtagcatactgtatgtatttttytacactttgcctytgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgttttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaagttgtctatctgtgtgtatattcatatcccattggcatttgttattgaaacttcattcaatttagattaactgatgaagaattgccttccccacctcaaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctatatcttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggaggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccggctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagtttcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaagggccccttttggcacggggggtctgacggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcytttctgagagcacagcaatgcctactcatcytgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatytgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaggccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttccagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacctctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagaaatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccctgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcctgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcatcacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaacctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgctgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagactgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggaggcccagggaggaccgcgcggaggagaaccatgctgaggagcccccggggagaacagaaccgcggcgagaggcccccggagagaaccgcgccgaagaacccccggggagaaccgcgccgaagaacccccggggagaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctggttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagccggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagagagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttattatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgctgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggaacagtggggagtctctaggaggttttcggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagttattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattctgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgacttttctccccaagagaacaccaaatccatttccttgggacatggataaggctaagggcagcacccacaaggaccaggagcggggttctcaacagccatttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcccccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttggggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgaacggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggccggttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtatgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccacctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgctgggatgtggcttccgtggactgagcagcctggagcccctacttgcttggtgtcccgagccagccggacatgcatcccgctctctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattattcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcgggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttcaaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccgggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggaaggagtggggcaggagggggctttgcagattacccagaccctttgttggccagtgtgggaatggggggaggccagggaggaacccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccacatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttccctccctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggtctccaggtttgagccccccggggtattagcccagcattttaggggctgccgtggtcatggagtaaagactacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaaaaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttctggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctctaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcccagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcatgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagaccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacttcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacatgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagacttcaggaaggagcagccatggggcagtggggctctggagcaacagaggcctcaaaagctcagcgtctacagatgttagggacaaggaggcagcttgggggatgtgctcgggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcaatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttctgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctgtcccggggccgagggtccagacctgttgccgagaagctgcttagcaaggcctaggggcaagggctggtctggcctagctctttctcccttgagccccctgccacagggctagggccatgctgtgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatatgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctagggcacgtgaagccctggctggccccgagtgcggtgtggttggcgcagatggcaacagggtcactctggctgcagagccaagaatggaccactgaggggctgggacagacctggcagaccaggagggaggccgctgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccgcctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagttggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttgatgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccacgttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggttctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcgctgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacactcacacacacactctctctctctctctctctctctctctctctctctctctctcgctctttctctctcccccctacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaggcttgtctagcgctggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtagctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgacgccctgcccggtggaggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaagaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccatgtcccacgcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgtggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggtggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacgtctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcgaggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggaccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcaagctggggttacctgacacttgtcatccttctgctgggcctcagcacccggcggagcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcagctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccatggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccatatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttagggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggctaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaaaatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaataaaaagtacaggggctctacacggcgccctgagaattgtgtgtaaatgagtgaaaatggggtgagagggagggagtgggaacagccaagaggccaggaagcagagcctgggtgcaggggcatcttgctggtgaagctggggagagacctgcgcaaccccacctgagtgaggcactgtgggcccagagtccaggtcagcgccaggggcagcaggggctggatctccggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggcggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccatgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcggggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatrttcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgcycagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactatgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgaccygggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtatgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaraaaaaraaaraaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaraaaaaaaaaaaaaaaaaaaaaaaaaaccccacagctaacatcacatcacacttaatagtgaagaacagaatactttccccctaaaataaaaaaraaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactattggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaactgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcrggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcacgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacrggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatttttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccatttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacwaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatcttwaaacagatttattttrgagytgggtacgatggctcacacctgtaataccaactacttgggaggctgaagtgagaggatcacttgagcccaggagtttgaaaccagcctgggcaaaataacaagaccccatcttagaagaaaaaaaaaaaaaataagaaagaaagaaataaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaagacagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggactttctggacaatgtgaaatagaaacgataacatccttgccttgcttcctgtctcaggaggaaagcgtatcacatttcactattaagtatgatgtctgcttagggtttgggtttttttgttttagtttttgtctttttttttttaggtaatggagtttctattcctagtttgctgagagttgtgtttttaattatgaacaggtctcgctttatcaaatgctttcttacaatctgttgtgttgattctattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccrcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatctttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacaggtgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccggggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtgatgggtgatccagaaggcaaaaatcacaaagcagggaaggctggggggtgacttgcctgagtcccttggagcggagggcgtgtgacgtgcttgagtgagtgcgtgtctgccggagcagggcggggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcaatatcccatcttacagaaaggagaacagggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagcatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccttccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccgggtcctgcccagcccggccccagctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacgttttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccagccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtggggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccgttacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccccgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcggcctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatataataagtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaaggggtttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattatcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcactcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgattaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccattgagaatgaagatgatgaattgttgctccttggaagacaatctgtcttttttctccggcggcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaacctttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactaatatattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaagaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtgttgaatgtggatggcagggaccatacgggatagcacactccagtagttgccaactcatggccccagtgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacaaccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagaggtcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagacgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcaactccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcgatgcacttcctcccggcatgcatgaaaacataaacgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcccggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctttccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccgggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaatggggcattgttcacggcctcacctgggctgtctccagcaccccaggatttacgaggactcggcccagagcctcgatgccggccgctccgggcagacctggagggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctaacggggccaggaggctgaagacaacctttccttgggctctcagcgatgccagctccagctgctgtgtcatcaaggtcgggcttggctggcctcttcctagcagaccttccaaaaccccgcagactcccgtggctgtaccagccctgcacctcctggccacctgcccctgcgtacccaccacccttgctcgggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaacttcagccctctcaccctcacaggggacccaagtgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatccgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttcttttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagaaggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgccgtcagtgcttggagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagttggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggatggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggggaaatgatggataggtggatgggtagattgagaaatgatggataggtggatgggtagatggatggaaggagacaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctcaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctggccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcacacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaacgtgagaccacactcaccctgtggtccagtgatctccttctgagaatccgccctggagcagtaacacccttgggactgagaatggcttctgggttgtgtgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgatcttcccctaacccctaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtctctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccgcataagccacttttggtattttttgccttgaaacttatccatcatattgtgttttcaattttattgatatgaaagtatatatcataatcacttacaattattcaattccctcggtagcagtagtattcattcctaattcttatttgttactttacttgcttaaggtttatctactttactggctcttcaaacaacctgcatttggttttattggtcaattctttttcataaaatatttttctattttgctaatatcttcctttgactttgttcattcttttctttgtatttgttttggtgttatttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatgtggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtcccyttccccacgtggtaattctggactgttcacagtggcttccaaggcctttgggatgggccttgcktkctrcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcakccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccaaaccccaaaggatgggtggaaattagctcaactaagtggagaggtgggatagtcatgggccaasgccccaaggcaggaargaataggcctggtctgtgggtctgagaggatggagagggctgaacacgggccaaaggagaaagttagggagggaaggtggagtccytggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggcgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgrgagtggagmtgggcatgcacamtaaggcctggaggctkrtgmttatcsatmatatagcaggcstgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggmtacgcagaggccctgggaggagggaggctaggcccaggggtggaaagaagacagatacgagaggggatttggagacacaatccccagacttggggacgagctggatatggtggygawggaggkgagtcttcaggamagacccccwggttctggcttggccatatgttggaggctgaaacgattcatccagacaggagcagggaggaggacatgcagggcctgaaagkttctgaggtgtccacgtggaggtgtttgcyyggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtccccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccgacttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcarggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcargttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggmtggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacytcagcaggcakggactagcacccaagaagamaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtrggtggggcaggagctctygtgatgaaaacaacagggattcagtaaatgcattcmakctaaaaaggaagamctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaacgcaaacagtaagtacttatttagcctagaattctaatttaactgtattggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaataccaaggtaaagccaagagatagtcggtagggttgaagggctgcctctgggaacagaaattagagatagaagatctagcgcccagggaaggctgtttaaagatgggagagcttcacgggttttctcactaagggtaagaaaatctaagaaggaagtgatggtgccagagaatagggaattctgccaataccctggtggggagggggagggggarggggargaggatgagaaggaaggaggagggargaggaaggaagagggaggaggaaggaggaggaargaggaggaaggaggagggaggargaaggargagrgwkgagggaggaagagagagaaggwagagattggccaaaggagctctgagaggggaaggtgggtgcatgccaccctggctgggaacagcaggtgtgtggtgaaggggaaagaccagcaggccctttacaccgtgggcacaggctcaggactggctgcggtgctacgcaggagccctctgactagctggggctggggctktgcaggataaggccagtgagagaagaggaytcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagatggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtacgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccacttccttccacattgcccctcctcccctctccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccascacccctgagggaaggcctggcccctcasgcacartkggggttgcccggcatcttggcagatgggcagcgttagagaagccttggacctgggcccttgcaaacggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcaccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggagacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggarcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctmagggccccgccaggtgaaggaacaagcttggaagggtgtcsttatgtmtgagagttggggagacacccccaagccccagatgggcytcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagagcccccaggcctggcctccaacctggccccagcctcaggggagctgaattcagagaatcctgtcctaggagccagaagcgggggagggagggaggscgsccytstcytgggtgcaggccmgggggctgggggctgcccgcccgtytkggtyarccgsarstgccaamccgsccctggckgagtyakkgggcctycatytycmrgcctkgcttgaggtgggaatagcagtgaggttggacatccaggcacctggarggtgggcagggctccctgcggctggggtggccagtggcacctggctgttgcccccctgcaccccagccctttggcccccaagtstctgccacctccctggggttctgctcccatattcctcacacccagcacagaacccagcatgtctcctgtagacacctgcatataaaccctgactcacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcakcgggctcascctgcaktgtccaggagcgacgggaagcctcgtggggctgttgggagacagcaagacctgggtcagcagagcaccgtgtggggtaagcagatgacagggcagtgacagggtgattcggscccggtcagtggtcccaggggtcggggacaggtgggaatcgaagtcataggaggcggggcaaaggccacggggaaagggacagagctgctcccaaggacgcaccaccatggggtgccccatggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcagcccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcstgtggagccctcagcytccacgcccaccagcagggactgggtggtgatgtcagcaatccccacagaaaggagggctgcacagccgtcccaggagccagcactgtccccgtgattctacatgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcarccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgccccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactcccyggcccctccctgctcgagaggtgaccaaggcccagggtctcccagcgagcaagaggccattgaactgttgttggctgtgcagtgccctgccctcggggaggcsgcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcagcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtsatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagraggaagcaggcttggggctgggggccagggaccggcgcgctgggaagcaggctgcagagtgaggccagggatgggggctgggccagaccacagggttgtgagcggactctggcattgatccggagccactgagggttagagcctatgacaggggtctgacttccagtggtatggggccaccctgctgggctggggaagggaggcgagaggaagtatctaaggtctgcttgtggacttccggggacagcgaggggtattgcwggggtcctaggggctggtgcaaytcagaggttccagatggcccagcaagtggctgagggcccagggtaggggaggatgtgggggcagcagggccgatgtgggcagacstggagcaatgacacgagaacggccaggcagccctgggyttyccctgcccacctgcccccgtggccgggytggggtttggctgaggcagcagagcgctcgctggctgcccgaacaaagtgttctgcctggtgtcccctggcamtccgggcytctgcgggctcgccagagggggcagctcaggaggcagcggcagagaatcaaatgcaggtggggcstgtgcccaccgccagcacaaacacggmtcmtgggcccccagcctgccsgamgttcctgcccgcctggcccccaaacagaggccgatgggacgagccctgcccggggttgcactaggtgggcaggtgggcaggtgggcagctgcctcgggytyttggacagagccgcccctgcctggcgtctgccggcaggaagctcctgaggccgggctagggataggccagcccttgggggaggctcgagaccccatcccagcctggggcttccccaccccytcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcakcctctgcaggtctgtgaggctgtggatgtgacagctctggctctggcacaaacgtcagccccaacccasatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctstggtggctggagccagctgggggagggaaggcagcaggggmtgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggaaggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagacggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggcaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcagcagagcttcctctggctgctcggcagacaacagacaccagggacagagacaaggttgaggatttggtctgcagcctctgagcggacacactcaccctcagtgcgtgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagatgacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcatgcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcatagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttctcacaagggggcggcaccatgatgcatcaaactgtggaaccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgttacgctctcgtaggtctctgggcgtcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccgttccccttcccagaggccccgccccaccctgccttttgctttcgccggctcctaacttgacacactgtgtccccccatatggcagctccgtggtctcgagatggagccttggggtgggagctgtggggacaggatgggagacatggcactttcagccagtgactctgaccttcttttcctgggcctcagtgtctgcatctgtgggatggagtgtgggcctctgtggctcgtccccaagtggctttgcagagcactgaagtgctggcgggtccttgggtgtgagagaccccggtggatggccgtgggcccttgcccgtgccaaaccacagaagtcctgcacccctttcttccatagtgtgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcaacctctcacagcaccctgttggccgcctcttccttagcctgctcagcctccgtggtaggtgctgtgggtgaccaccacagcacccaacccttgaagctggcccgggtccacccagaccctagcaaactggttggaccctctctggccatcccggggcttgtgcccaccttcacccagcagcatcttccctggggttgttctcacccgcacagaacccagccttggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccttgagcctgaatgcctgtggacacatatagggactcccagcacgcacgggatggattccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccaccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttaaggacgtcgctcctgttctgggccctggggctggccct

What is claimed is:

1. A method of administering iloperidone or a metabolite thereof to treating a human individual the method comprising:
   determining or having determined the individual's KCNQ1 genotype at position 78927 of SEQ. ID. 1 ; and
   in the case that the individual's KCNQ1 genotype at position 78927 of SEQ. ID. 1 is associated with an increased risk of QT prolongation, administering to the individual a first quantity of iloperidone or a metabolite thereof, and
   in the case that the individual's KCNQ1 genotype at position 78927 of SEQ. ID. 1 is not associated with an increased risk of QT prolongation, administering to the individual a second quantity of iloperidone or a metabolite thereof, wherein the first quantity is less than the second quantity,
   wherein a KCNQ1 genotype of CC at position 78927 of SEQ. ID. 1 is associated with an increased risk of QT prolongation, and the KCNQ1 genotype not associated with an increased risk of QT prolongation is non-CC at position 78927 of SEQ. ID. 1.

2. The method of claim 1, wherein the method comprises administering iloperidone to the individual.

3. The method of claim 1, wherein the method comprises administering a metabolite of iloperidone to the individual, wherein the metabolite is 1-[4-[3-[4-(6-Fluoro-1,2-benzisoxazol-3-y1)-1-piperidinyl] propoxy]-3-methoxyphenyl]ethanol.

4. The method of claim 1, further comprising:
   determining or having determined at least a portion of the patient's CYP2D6 genotype, in the case that the individual's CYP2D6G1846A genotype is AA or GA or the individual's CYP2D6C100T genotype is TT or CT, and the individual has a KCNQ1 genotype of CC at position 78927 of SEQ. ID. 1, administering to the individual the first quantity of iloperidone or the metabolite thereof, and in the case that the individual's CYP2D6G1846A genotype is GG or the individual's CYP2D6C100T genotype is CC, and the individual's KCNQ1 genotype is non-CC at position 78927 of SEQ. ID. 1, administering to the individual the second quantity of iloperidone or the metabolite thereof.

5. The method of claim 1, wherein the human individual is suffering from at least one condition selected from a group consisting of:
   schizophrenia, including paranoid schizophrenia, catatonic schizophrenia, disorganized schizophrenia, undifferentiated schizophrenia, and residual schizophrenia; schizoaffective disorder, depression, bipolar mania/depression, cardiac arrythmia, Tourette's Syndrome, a psychotic disorder, including brief psychotic disorder, a psychotic disorder not otherwise specified, a psychotic disorder due to a general medical condition, and a substance-induced psychotic disorder; a delusional disorder, and schizophreniform disorder.

6. The method of claim 1, wherein the second quantity of iloperidone is 24 mg/day.

7. The method of claim 1, wherein the KCNQ 1 genotype not associated with an increased risk of QT prolongation is AC or AA at position 78927 of SEQ ID NO: 1.

8. A method of treating a human individual with iloperidone or a metabolite thereof, the method comprising:

characterizing an expression product of the individual's KCNQ1 gene; and in the case that the characterized expression product corresponds to a KCNQ1 genotype of CC at position 78927 of SEQ. ID. 1, administering to the individual a first quantity of iloperidone or a metabolite thereof, and in the case that the characterized expression product corresponds to a KCNQ1 genotype of non-CC at position 78927 of SEQ. ID. 1, administering to the individual a second quantity of iloperidone or a metabolite thereof, wherein the first quantity is less than the second quantity.

9. The method of claim 8, further comprising:

characterizing an expression product of the individual's CYP2D6 gene; and determining whether the characterized expression product corresponds to a CYP2D6 polymorphism selected from a group consisting of: CYP2D6G1846A and CYP2D6C100T.

10. The method of claim 8, wherein the second quantity of iloperidone is 24 mg/day.

11. The method of claim 8, wherein the non-CC KCNQ1 genotype at position 78927 of SEQ ID NO: 1 is AC or AA.

12. A method of administering iloperidone or a metabolite thereof to a human individual suffering from long QT syndrome (LQTS), the method comprising:

determining or having determined the individual's KCNQ1 genotype at position 78927 of SEQ. ID. 1; and administering to the individual a quantity of the iloperidone or the metabolite thereof based on the individual's KCNQ1 genotype at position 78927 of SEQ. ID. 1, wherein a first quantity is administered to the individual in a case in which the individual has a KCNQ1 genotype of CC at position 78927 of SEQ. ID. 1, and a second quantity is administered to the individual in a case in which the individual has a KCNQ1 genotype that is non-CC at position 78927 of SEQ. ID. 1.

13. The method of claim 12, further comprising:

determining or having determined the individual's CYP2D6 genotype; and determining whether the individual's CYP2D6 genotype corresponds to a CYP2D6 polymorphism selected from a group consisting of: CYP2D6G1846A and CYP2D6C100T.

14. The method of claim 12, wherein the second quantity of iloperidone is 24 mg/day.

15. The method of claim 12, wherein the non-CC KCNQ1 genotype at position 78927 of SEQ ID NO: 1 is AC or AA.

* * * * *